US012583927B2

(12) United States Patent
Bamdad et al.

(10) Patent No.: US 12,583,927 B2
(45) Date of Patent: Mar. 24, 2026

(54) **ANTI-VARIABLE MUC1\* ANTIBODIES AND USES THEREOF**

(71) Applicant: MINERVA BIOTECHNOLOGIES CORPORATION, Waltham, MA (US)

(72) Inventors: Cynthia Bamdad, Waltham, MA (US); Benoit Smagghe, Waltham, MA (US)

(73) Assignee: MINERVA BIOTECHNOLOGIES CORPORATION, Waltham, MA (US)

( * ) Notice: Subject to any disclaimer, the term of this patent is extended or adjusted under 35 U.S.C. 154(b) by 239 days.

(21) Appl. No.: 17/373,609

(22) Filed: Jul. 12, 2021

(65) Prior Publication Data

US 2022/0184120 A1 Jun. 16, 2022

Related U.S. Application Data

(63) Continuation of application No. PCT/US2020/013410, filed on Jan. 13, 2020, which is a continuation-in-part of application No. PCT/US2019/021556, filed on Mar. 11, 2019, and a (Continued)

(51) Int. Cl.

| | |
|---|---|
| *C07K 16/28* | (2006.01) |
| *A61K 35/17* | (2025.01) |
| *A61K 39/00* | (2006.01) |
| *A61K 40/10* | (2025.01) |
| *A61K 40/31* | (2025.01) |
| *A61K 40/42* | (2025.01) |
| *C12N 9/50* | (2006.01) |

(52) U.S. Cl.
CPC .......... *C07K 16/2863* (2013.01); *A61K 35/17* (2013.01); *A61K 39/00117* (2018.08); *A61K 40/10* (2025.01); *A61K 40/31* (2025.01); *A61K 40/4257* (2025.01); *C12N 9/50* (2013.01); *C07K 2317/565* (2013.01)

(58) Field of Classification Search
CPC .......... C07K 16/2863; C07K 2317/622; A61K 39/00117; A61K 39/46447
See application file for complete search history.

(56) References Cited

U.S. PATENT DOCUMENTS

| | | | |
|---|---|---|---|
| 7,709,226 B2 | 5/2010 | Foote | |
| 10,421,819 B2 | 9/2019 | Bamdad et al. | |
| 11,976,132 B2 * | 5/2024 | Bamdad .......... | G01N 33/57407 |

(Continued)

FOREIGN PATENT DOCUMENTS

| | | |
|---|---|---|
| CN | 110903401 A | 3/2020 |
| WO | WO-0157277 A2 | 8/2001 |

(Continued)

OTHER PUBLICATIONS

Chames, P., et al., "Therapeutic antibodies: successes, limitations and hopes for the future", British Journal of Pharmacology (2009), 157, 220-233. (Year: 2009).*

(Continued)

*Primary Examiner* — Zachariah Lucas

(74) *Attorney, Agent, or Firm* — WILSON SONSINI GOODRICH & ROSATI

(57) ABSTRACT

The present application discloses an antibody, or fragment thereof, for the diagnosis, treatment or prevention of cancers wherein the antibody specifically binds to the PSMGFR peptide (SEQ ID NO:2) or a fragment thereof of the peptide.

8 Claims, 258 Drawing Sheets

Specification includes a Sequence Listing.

Related U.S. Application Data continuation-in-part of application No. PCT/US2019/019566, filed on Feb. 26, 2019.

(60) Provisional application No. 62/791,661, filed on Jan. 11, 2019.

(56) References Cited

U.S. PATENT DOCUMENTS

| | | | |
|---|---|---|---|
| 12,115,192 B2 | 10/2024 | Bamdad et al. | |
| 2013/0274446 A1* | 10/2013 | Kumagai | C07K 16/2863 |
| | | | 435/69.6 |
| 2016/0257758 A1 | 9/2016 | Gray et al. | |
| 2017/0204191 A1 | 7/2017 | Bamdad et al. | |
| 2017/0204196 A1 | 7/2017 | Bamdad et al. | |
| 2018/0112007 A1 | 4/2018 | Bamdad et al. | |
| 2019/0290692 A1 | 9/2019 | Bamdad et al. | |
| 2024/0261331 A1 | 8/2024 | Bamdad et al. | |
| 2024/0261406 A1 | 8/2024 | Bamdad et al. | |
| 2024/0390418 A1 | 11/2024 | Bamdad et al. | |
| 2024/0424025 A1 | 12/2024 | Bamdad et al. | |

FOREIGN PATENT DOCUMENTS

| | | | |
|---|---|---|---|
| WO | WO-2009103969 A8 | 1/2010 | |
| WO | WO-2010042562 A2 | 4/2010 | |
| WO | WO-2014028668 A2 | 2/2014 | |
| WO | WO-2015116753 A1 | 8/2015 | |
| WO | WO-2016130726 A1 | 8/2016 | |
| WO | WO-2018071583 A2 | 4/2018 | |
| WO | WO-2018132506 A1 | 7/2018 | |
| WO | WO-2019104306 A1 | 5/2019 | |
| WO | WO-2019124468 A1 | 6/2019 | |
| WO | WO-2019133969 A2 | 7/2019 | |
| WO | WO-2019165421 A1 * | 8/2019 | A61K 35/17 |
| WO | WO-2020080908 A1 | 4/2020 | |
| WO | WO-2020117004 A1 | 6/2020 | |
| WO | WO-2020146902 A2 | 7/2020 | |
| WO | WO-2022027039 A1 | 2/2022 | |

OTHER PUBLICATIONS

Feucht et al. Calibration of CAR activation potential directs alternative T cell fates and therapeutic potency. Nat Med. 25(1):82-88 (2019).

Long et al. 4-1BB Costimulation Ameliorates T Cell Exhaustion Induced by Tonic Signaling of Chimeric Antigen Receptors. Nat Med 21(6):581-590 (2015).

U.S. Appl. No. 15/549,942 Office Action dated Jan. 11, 2023.

U.S. Appl. No. 16/539,247 Office Action dated Jun. 1, 2022.

U.S. Appl. No. 17/817,515 Office Action dated Apr. 26, 2023.

Cohen, David A. et al. Interobserver agreement among pathologists for semiquantitative hormone receptor scoring in breast carcinoma. Am J Clin Pathol 138(6):796-802 (2012).

Falahat, Rana et al. A Cell ELISA for the quantification of MUC1 mucin (CD227) expressed by cancer cells of epithelial and neuroectodermal origin. Cell Immunol 298(1-2):96-103 (2015).

Rudikoff, et al. Single Amino Acid Substitution Altering Antigen-binding Specificity. PNAS USA 79(6):1979-1983 (1982).

Tiller et al. Facile Affinity Maturation of Antibody Variable Domains Using Natural Diversity Mutagenesis. Front. Immunol. 8:986 (2017).

U.S. Appl. No. 18/408,259 Office Action dated Jul. 1, 2024.

Abe et al., Structural analysis of the DF3 human breast carcinoma-associated protein. Cancer Res 49:2834-2839 (1989).

Al-Lazikani, Bissan, et al., Standard Conformations for the Canonical Structures of Immunoglobulins. Journal of Molecular Biology 273(4):927-948 (1997).

Arcangeli et al., CAR T cell manufacturing from naive/stem memory T lymphocytes enhances antitumor responses while curtailing cytokine release syndrome. The Journal of Clinical Investigation 132(12):e150807 (2022).

Braga et al., Spatial and temporal expression of an epithelial mucin, Muc-1, during mouse development. Development 115(2):427-437 (1992).

Brentjens et al., Safety and persistence of adoptively transferred autologous CD19-targeted T cells in patients with relapsed or chemotherapy refractory Bcell leukemias. Blood 118(18):4817-4828 (2011).

Brinkmann et al. The making of bispecific antibodies. MABS 9(2):182-212 (2017).

Brudno et al., Chimeric antigen receptor T-cell therapies for lymphoma. Nature Reviews Clinical Oncology 15:31-46 (2017).

Carmon et al., Long Term Update on Phase I/II Trial with Immucin Anti-MUC1 Signal Peptide Vaccine for Multiple Myeloma Patients with Residual Disease or Progression. Blood 124(21):4768 (2014).

Chen et al. Multiple Cancer/Testis Antigens Are Preferentially Expressed in Hormone-Receptor Negative and High-Grade Breast Cancers. PLoS One 6(3):e17876 (2011).

Chothia, Cyrus, et al., Canonical Structures for the Hypervariable Regions of Immunoglobulins. Journal of Molecular Biology 196(4):901-917 (1987).

Chothia, Cyrus, et al., Structural Repertoire of the Human VH Segments. Journal of Molecular Biology 227(3):799-817 (1992).

Cooper, et al. T-cell clones can be rendered specific for CD19: toward the selective augmentation of the graft-versus-B-lineage leukemia effect. Blood. Feb. 15, 2003;101(4):1637-44. Epub Oct. 10, 2002.

Co-pending U.S. Appl. No. 18/018,536, inventors Bamdad; Cynthia et al., filed Jan. 27, 2023.

Co-pending U.S. Appl. No. 18/408,259, inventors Bamdad; Cynthia et al., filed Jan. 9, 2024.

Co-pending U.S. Appl. No. 18/429,758, inventors Bamdad; Cynthia et al., filed Feb. 1, 2024.

Courtenay-Luck, Chapter 8: Genetic Manipulation of Monoclonal Antibodies. Monoclonal Antibodies: Production, Engineering and Clinical Application: 166-179 (1995).

Curigliano et al., Cancer-testis antigen expression in triple negative breast cancer. Annals of oncology: official journal of the European Society for Medical Oncology / ESMO 22(1):98-103 (2011).

Davila, et al., Chimeric antigen receptors for the adoptive T cell therapy of hematologic malignancies. International Journal of Hematology 99(4):361-371 (2014).

Denardo, David G, et al., Leukocyte Complexity Predicts Breast Cancer Survival and Functionally Regulates Response to Chemotherapy. Cancer Discovery 1(1):54-67 (2011).

Denkert et al., Tumor-associated lymphocytes as an independent predictor of response to neoadjuvant chemotherapy in breast cancer. Journal of clinical oncology: official journal of the American Society of Clinical Oncology 28(1):105-113 (2010).

Dudley et al. Adoptive Cell Transfer Therapy Following Non-Myeloablative but Lymphodepleting Chemotherapy for the Treatment of Patients With Refractory Metastatic Melanoma. J Clin Oncol. 23(10):2346-2357 (2005).

FDA Briefing Document: BLA 125646 Tisagenlecleucel https://www.fda.gov/downloads/AdvisoryCommittees/CommitteesMeetingMaterials/Drugs/OncologicDrugsAdvisoryCommittee/UCM566166.pdf Accessed Feb. 20, 2018.

Fiedler et al., A phase I study of PankoMab-GEX, a humanised glyco-optimised monoclonal antibody to a novel tumour-specific MUC1 glycopeptide epitope in patients with advanced carcinomas, European Journal of Cancer 63:55-63 (2016).

Finak et al., Stromal gene expression predicts clinical outcome in breast cancer. Nature Medicine 14(5):518-527 (2008).

Gendler et al., Cloning of partial cDNA encoding differentiation and tumor-associated mucin glycoproteins expressed by human mammary epithelium. Proc. Natl. Acad. Sci. U.S.A. 84:6060-6064 (1987).

Gendler, et al. Molecular cloning and expression of human tumor-associated polymorphic epithelial mucin. J Biol Chem. 265:15286-15293 (1990).

Hai et al., The relationship between MMP-2 and MMP-9 expression levels with breast cancer incidence and prognosis. Oncology Letters 14: 5865-5870 (2017).

(56)             References Cited

OTHER PUBLICATIONS

Hanisch et al., MUC1: the polymorphic appearance of a human mucin. Glycobiology 10:439-449 (2000).

Hikita, Sherry, et al., MUC1* Mediates the Growth of Human Pluripotent Stem Cells. Public Library of Science One 3(10):e3312,1-13 (2008).

Hilkens et al., Monoclonal antibodies against human milk-fat globule membranes detecting differentiation antigens of the mammary gland and its tumors. Int. J. Cancer 34:197-206 (1984).

Hudecek, et al. Adoptive T-cell therapy for B-cell malignancies. Expert review of hematology 2.5 (Oct. 2009): 517-532.

Huston, James S, et al., Protein Engineering of Single-chain Fv Analogs and Fusion Proteins. Methods in Enzymology 203:46-96 (1991).

Hwu et al., The genetic modification of T cells for cancer therapy: an overview of laboratory and clinical trials.Cancer Detect Prev. 18(1):43-50 (1994).

June et al., Engineering lymphocyte subsets: tools, trials and tribulations. Nat Rev Immunol 9.10:704-716 (2009).

Kabat, Elvin A, et al., Attempts to Locate Complementarity-Determining Residues in the Variable Positions of Light and Heavy Chains. Annals of the New York Academy of Sciences 190:382-393 (1971).

Kabat et al.: Sequences of Proteins of Immunological Interest, NIH Publication No. 91-3242. U.S. Department of Health and Human Services, Public Health Service, National Institutes of Health 1:647-669 (1991).

Kalos, et al., T Cells with Chimeric Antigen Receptors Have Potent Antitumor Effects and Can Establish Memory in Patients with Advanced Leukemia. Science Translation Medicine 3:95ra73 (2011).

Kawalekar et al.: Distinct Signaling of Coreceptors Regulates Specific Metabolism Pathways and Impacts Memory Development in CAR T Cells. Immunity. 44:380-390 (2016).

Kershaw et al., Supernatural T cells: genetic modification of T cells for cancer therapy. Nature Reviews: Immunology 5(12):928-940 (2005).

Kim et al., Novel antibodies targeting MUC1-C showed anti-metastasis and growth-inhibitory effects on human breast cancer cells. Int J Mol Sci. 21(9):3258. doi: 10.3390/ijms21093258 (2020).

Kochenderfer et al., Abstract 765: Treatment of Chemotherapy-Refractory B-Cell Malignancies with Anti-CD19 Chimeric Antigen Receptor T Cells. Presented at the Annual Meeting of the American Society of Gene and Cell Therapy. New Orleans, LA. (2014).

Kochenderfer et al., Adoptive transfer of syngeneic T cells transduced with a chimeric antigen receptor that recognizes murine CD19 can eradicate lymphoma and normal B cells. Blood 116:3875-3886 (2010).

Kochenderfer et al., B-cell depletion and remissions of malignancy along with cytokine-associated toxicity in a clinical trial of anti-CD19 chimeric-antigen-receptor-transduced T cells. Blood 119(12):2709-2720 (2012).

Kochenderfer et al., Chemotherapy-refractory diffuse large B-cell lymphoma and indolent B-cell malignancies can be effectively treated with autologous T cells expressing an anti-CD19 chimeric antigen receptor, Journal of Clinical Oncology 33(6):540-549 (Feb. 20, 2015).

Kochenderfer et al., Chimeric antigen receptor-modified T cells in CLL. The New England Journal of Medicine 365(20):1937-1938 (2011).

Kufe, et al. Differential reactivity of a novel monoclonal antibody (DF3) with human malignant versus benign breast tumors. Hybridoma 3:223-232 (1984).

Lamers et al., Treatment of metastatic renal cell carcinoma with CAIX CAR-engineered T cells: clinical evaluation and management of on-target toxicity. Molecular Therapy : the Journal of the American Society of Gene Therapy 21(4):904-912 (2013).

Lan, M S, et al., Cloning and Sequencing of a Human Pancreatic Tumor Mucin cDNA. Journal of Biological Chemistry 265(25):15294-15299 (1990).

Larrick, James W, et al., PCR Amplification of Antibody Genes. Methods 2(2):106-110 (1991).

Lee et al., Current concepts in the diagnosis and management of cytokine release syndrome. Blood, 124:188-195 (2014).

Lefranc, Marie-Paule, et al., IMGT, the International ImMunoGeneTics Database. Nucleic Acids Research 27(1):209-212 (1999).

Lefranc, Marie-Paule, et al., The IMGT Unique Numbering for Immunoglobulins, T-Cell Receptors, and Ig-Like Domains. The Immunologist 7:132-136 (1999).

Lehmann. Identification of human triple-negative breast cancer subtypes and preclinical models for selection of targeted therapies. J Clinical Invest. 121(7):2750-2767 (2011).

Ligtnberg et al. Episialin, a carcinoma associated mucin, is generated by a polymorphic gene encoding splice variants with alternative amino termini. J. Biol. Chem. 265:5573-5578 (1990).

Lynn et al. c-Jun overexpression in CAR T cells induces exhaustion resistance. Nature 576(7786):293-300 (2019).

MacCallum, Robert M, et al., Antibody-Antigen Interactions: Contact Analysis and Binding Site Topography. Journal of Molecular Biology 262(5):732-745 (1996).

Maher et al. Human T-lymphocyte cytotoxicity and proliferation directed by a single chimeric TCRzeta /CD28 receptor. Nat Biotech 20(1):70-75 (2002).

Mahmoud et al., Tumor-infiltrating CD8+ lymphocytes predict clinical outcome in breast cancer. J Clin Oncol 29(15):1949-1955 (2011).

Majzner, Robbie G, et al., Tuning the Antigen Density requirement for CAR T Cell Activity. Cancer Discovery 10(5):702-723 (2020).

Martin, Andrew C, Chapter 3: Protein Sequence and Structure Analysis of Antibody Variable Domains. In Antibody Engineering, Kontermann and Diibel, Editions, Springer-Verlag, Berlin:422-439 (2001).

Maude, et al., Managing Cytokine Release Syndrome Associated With Novel T Cell-engaging Therapies. Cancer Journal 20(2):119-22 (2014).

McGuckin et al., Prognostic significance of MUC1 epithelial mucin expression in breast cancer Human Pathology. 26(4):432-439 (1995).

Meyerholz, David K, et al., Principles and Approaches for Reproducible Scoring of Tissue Stains in Research. Laboratory Investigation 98(7):844-855 (2019).

Morgan, Richard A, et al., Cancer Regression in Patients After Transfer of Genetically Engineered Lymphocytes. Science 314(5796):126-129 (2006).

Muller et al., High density oglycosylation on tandem repeat peptide from secretory MUC1 of T47D breast cancer cells. J. Biol. Chem. 274:18165-18172 (1999).

Kochenderfer et al., Eradication of B-lineage cells and regression of lymphoma in a patient treated with autologous T cells genetically engineered to recognize CD19 (Blood, 2010, 116:4099-4102) (Year: 2010).

Neelapu et al., Chimeric antigen receptor T-cell therapy— assessment and management of toxicities. Nat Rev Clin Oncol. 15(1):47-62 (2018).

Nemunaitis et al., Tolerability, humoral immune response, and disease control in phase 1 patients receiving ONT-10, a MUC1 liposomal vaccine. Journal of Clinical Oncology 32:3091 (2014).

Newrzela et al., Resistance of mature T cells to oncogene transformation. Blood 112(6):2278-2286 (2008).

Park et al., A Phase I Study of CD19-Targeted 19(T2)28z1xx CAR T Cells in Adult Patients with Relapsed or Refractory Diffuse Large B-Cell Lymphoma American Society of Hemtology, Abstract 163, Session 704. Cellular Immunotherapies: Early Phase and Investigational Therapies: Lymphoma Hematology Disease Topics & Pathways (2022).

Park, et al., Adoptive Transfer of Chimeric Antigen Receptor Re-directed Cytolytic T Lymphocyte Clones in Patients with Neuroblastoma. Mol Ther 15(4):825-833 (2007).

Patel et al., Cancer CARtography: charting out a new approach to cancer immunotherapy. Immunotherapy 6(6):675-678 (2014).

PCT/US2021/071017 International Search Report and Written Opinion dated Dec. 29, 2021.

(56)            References Cited

OTHER PUBLICATIONS

Pegram et al., Phase I dose escalation pharmacokinetic assessment of intravenous humanized anti-MUC1 antibody AS1402 in patients with advanced breast cancer. Breast Cancer Research 11(5):R73 (2009).

Porter et al., Chimeric antigen receptor-modified T cells in chronic lymphoid leukemia. N Engl J Med 365:725-733 (2011).

Quintarelli et al., Choice of costimulatory domains and of cytokines determines CAR T-cell activity in neuroblastoma. OncoImmunology 7(6):e1433518 (2018).

Quoix et al., TG4010 immunotherapy and first-line chemotherapy for advanced non-small-cell lung cancer (TIME): results from the phase 2b part of a randomised, double-blind, placebo-controlled, phase 2b/3 trial. Lancet Oncology 17(2):212-223 (2016).

Ram, Sripad, et al., Pixelwise H-score: a Novel Digital Image Analysis-based Metric to Quantify Membrane Biomarker Expression From Immunohistochemistry Images. PLOS One 16(9): 20 pages (2021).

Ren et al., Human MUC1 carcinoma-associated protein confers resistance to genotoxic anticancer agents. Cancer Cell 5(2):163-175 (2004).

Sadelain, Michel, et al., Targeting Tumours With Genetically Enhanced T Lymphocytes. Nature Reviews Cancer 3(1):35-45 (2003).

Salter, et al., Phosphoproteomic Analysis of Chimeric Antigen Receptor Signaling Reveals Kinetic and Quantitative Differences That Affect Cell Function. Science Signaling 11(544): 18 Pages (2018).

Schulert et al., Pathogenesis of macrophage activation syndrome and potential for cytokine-directed therapies. Annu Rev Med. 66:145-159 (2015).

Shah, Nirali N, et al., Mechanisms of Resistance to CAR T Cell Therapy. Nature Reviews Clinical Oncology 16(6):372-385 (2019).

Shigeta, Keisuke, et al., Role of the MUC1-C Oncoprotein in the Acquisition of Cisplatin Resistance by Urothelial Carcinoma. Cancer Science 111(10):3639-3652 (2020).

Smagghe et al. MUCI* ligand, NM23-H1, is a novel growth factor that maintains human stem cells in a more naive state. PLoS One 8(3):E58601 (Mar. 2013).

Spiess, Christoph, et al., Alternative Molecular Formats and Therapeutic Applications for Bispecific Antibodies. Molecular Immunology 67(2 Pt A):95-106 (2015).

Study of GO-203-2C Given Intravenously in Patients With Advanced Solid Tumors Including Lymphomas. https://ctv.veeva.com/study/study-of-go-203-2c-given-intravenously-in-patients-with-advanced-solid-tumors-including-lymphomas (2013).

Suhoski et al., Engineering artificial antigen-presenting cells to express a diverse array of co- stimulatory molecules. Molecular Therapy 15(5):981-988 (2007).

Takahashi et al., Feasibility study of personalized peptide vaccination for metastatic recurrent triple-negative breast cancer patients. Breast Cancer Research: BCR 16(4):R70 (2014).

Tchou et al., Mesothelin, a novel immunotherapy target for triple negative breast cancer. Breast cancer research and treatment. 133(2):799-804 (2012).

Thie et al., Rise and fall of an anti-MUC1 specific antibody. PLoS One 6(1):e15921 (2011).

Tramontano, A, et al., Framework Residue 71 Is a Major Determinant of the Position and Conformation of the Second Hypervariable Region in the VH Domains of Immunoglobulins. Journal of Molecular Biology 215(1):175-182 (1990).

Turtle et al. CD19 CAR-T cells of defined CD4+:CD8+ composition in adult B cell ALL patients. J Clin Invest 126(6):2123-2138 (2016).

Turtle et al., Immunotherapy of non-Hodgkin's lymphoma with a defined ratio of CD8+ and CD4+ CD19-specific chimeric antigen receptor-modified T cells. Sci Transl Med. 8(355):355ra116 (2016).

Turtle et al., Therapy of B Cell Malignancies with CD19-Specific Chimeric Antigen Receptor-Modified T Cells of Defined Subset Composition. Blood 124: Abstract 384 (2014).

U.S. Appl. No. 18/429,758 Office Action dated Apr. 4, 2024.

Wang et al., Phase 1 studies of central memory-derived CD19 CAR T-cell therapy following autologous HSCT in patients with B-cell NHL. Blood 127:2980-2990 (2016).

Ward, et al., Genetic Manipulation and Expression of Antibodies. Monoclonal Antibodies: Principles and Applications, Wiley-Liss Inc:137-185 (1995).

Westgaard et al., Differentiation markers in pancreatic head adenocarcinomas: MUC1 and MUC4 expression indicates poor prognosis in pancreatobiliary differentiated tumours Histopathology 54(3):337-347 (2009).

Wreschner et al., Human epithelial tumor antigen cDNA sequences. Differential splicing may generate multiple splicing forms. Eur J Biochem 189:463-473 (1990).

Wrzesinski et al., Hematopoietic stem cells promote the expansion and function of adoptively transferred antitumor CD8 T cells. The Journal of Clinical Investigation 117(2):492-501 (2007).

Yousef et al. MMP-9 expression varies according to molecular subtypes of breast cancer. BMC Cancer 14:609 (2014).

Zaretsky et al., Expression of genes coding for pS2, c-erbB2, estrogen receptor and the H23 breast tumor-associated antigen. A comparative analysis in breast cancer. FEBS Lett. 265:46-50 (1990).

In FDA (Food and Drug Administration): Oncologic Drugs Advisory Committee Meeting, BLA 125646 Tisagenlecleucel Novartis Pharmaceuticals Corporation, Jul. 12, 2017; Available at URL: https://www.fda.gov/media/106081/download pp. 1-66.

Zhao, Yangbing et al. A herceptin-based chimeric antigen receptor with modified signaling domains leads to enhanced survival of transduced T lymphocytes and antitumor activity. Journal of immunology 183(9):5563-5574 (2009).

Zheng, Wenting. et al. PI3K orchestration of the in vivo persistence of chimeric antigen receptor-modified T cells. Leukemia 32(5):1157-1167 (2018).

Baeuerle et al. Bispecific T-cell engaging antibodies for cancer therapy. Cancer Res 69:4941-4944 (2009).

Carter et al. A Primitive Growth Factor, NME7AB , Is Sufficient to Induce Stable Naïve State Human Pluripotency; Reprogramming in This Novel Growth Factor Confers Superior Differentiation. Stem Cells 34(4):847-59 (2016).

Czajkowsky, et al. Fc-fusion proteins: new developments and future perspectives. EMBO Mol Med. Oct. 2012; 4(10): 1015-1028. Published online Jul. 26, 2012.

Dai et al. Chimeric Antigen Receptors Modified T-Cells for Cancer Therapy. J Natl Cancer Inst. 108(7):djv439 (2016).

Fessler et al. MUC1* is a determinant of trastuzumab (Herceptin) resistance in breast cancer cells. Breast Cancer Res Treat 118:113-134 (2009).

Hombach et al. 0X40 costimulation by a chimericantigen receptor abrogates CD28 and IL-2 induced IL-10 secretion by redirectedCD4(+) T cells. Oncoimmunology 1(4):458-466 (2012).

Kowolik et al. CD28 costimulation provided through a CD19-specific chimeric antigen receptor enhances in vivo persistence and antitumor efficacy of adoptively transferred T cells. Cancer Res 66(22):10995-11004 (2006).

Loskog et al. Addition of the CD28 signaling domain to chimeric T-cell receptors enhances chimeric T-cell resistance to T regulatory cells. Leukemia 20(10):1819-1828 (2006).

Lyakh et al. Expression of NFAT-Family proteins in normal human T cells, Molecular and Cellular Biology 17(5):2475-2484 (1997).

Macian. NFAT Proteins: Key Regulators of T-Cell Development and Function. Nat. Rev. Immunol. 5(6):472-84 (2005).

Mahanta et al. A Minimal Fragment of MUCI Mediates Growth of Cancer Cells. PLoS One 3(4):e2054 (2008).

Milone et al. Chimeric receptors containing CD137 signal transduction domains mediate enhanced survival of T cells and increased antileukemic efficacy in vivo. Mol Ther 17(8):1453-1464 (2009).

Owyong et al. MMP9 modulates the metastatic cascade and immune landscape for breast cancer anti-metastatic therapy. Life Sci Alliance 2(6):e201800226 (2019).

PCT/US2020/013410 International Search Report and Written Opinion dated Jul. 23, 2020.

PCT/US2020/013410 Invitation to Pay Additional Fees dated May 1, 2020.

(56)                    References Cited

OTHER PUBLICATIONS

Pule et al. A chimeric T cell antigen receptor that augments cytokine release and supports clonal expansion of primary human T cells. Mol Ther 12(5):933-941 (2005).
Rao et al. Transcription factors of the NFAT family: regulation and function. Annu Rev Immunol. 15:707-747 (1997).
Song et al. In Vivo Persistence, Tumor Localization, and Antitumor Activity of CAR-Engineered T Cells Is Enhanced by Costimulatory Signaling through CD137 (4-1BB). Cancer Res 71(13):4617-4627 (2011).
Van't Veer et al. Gene expression profiling predicts clinical outcome of breast cancer. Nature 415(6871):530-536 (2002).
Bamdad et al. Abstract 3330: MUC1* targeting Car T. Cancer Research 77(13):3330 (2017).
Hughes-Parry, Hannah E. et al. The Evolving Protein Engineering in the Design of Chimeric Antigen Receptor T Cells. Int J Mol Sci 21(1):204, 1-15 (2019).
U.S. Appl. No. 18/018,536 Office Action dated Jan. 29, 2025.

* cited by examiner

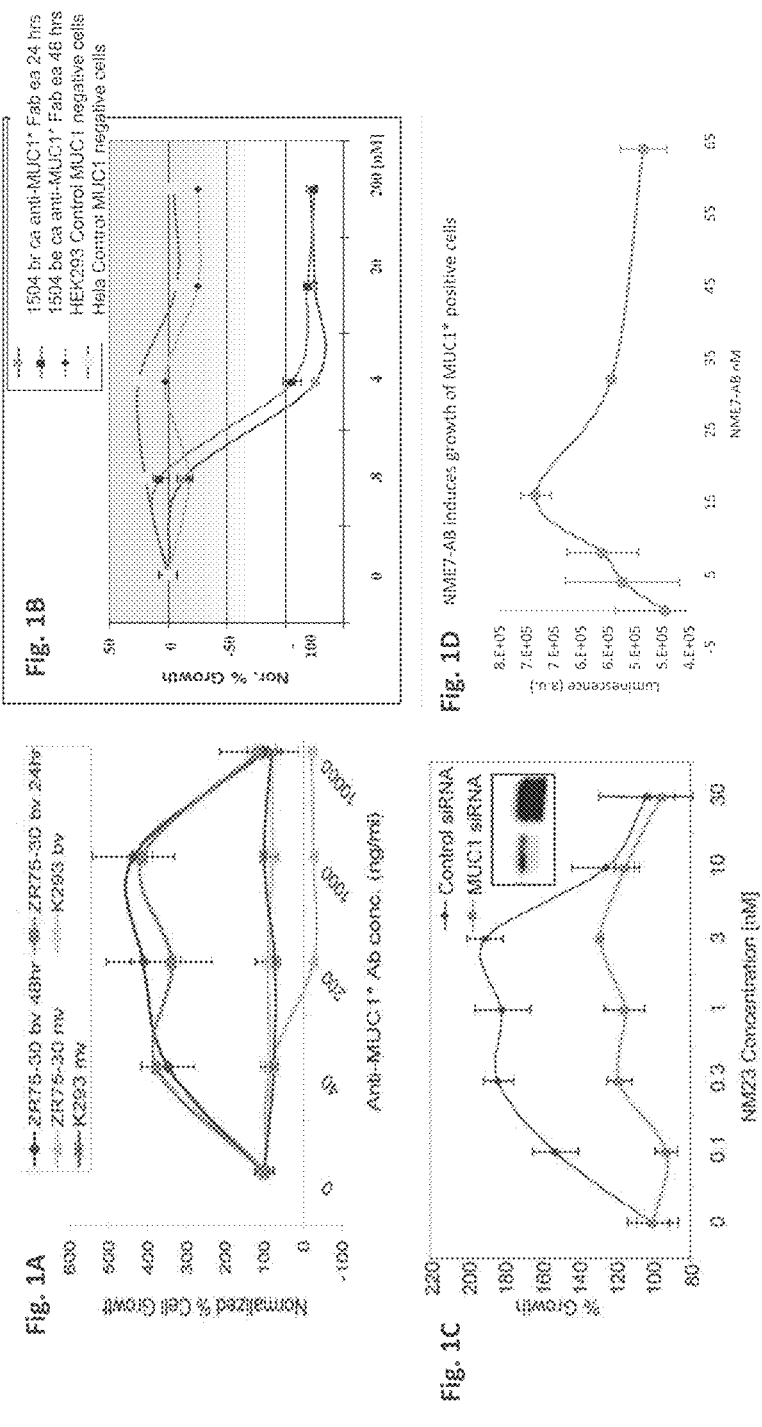

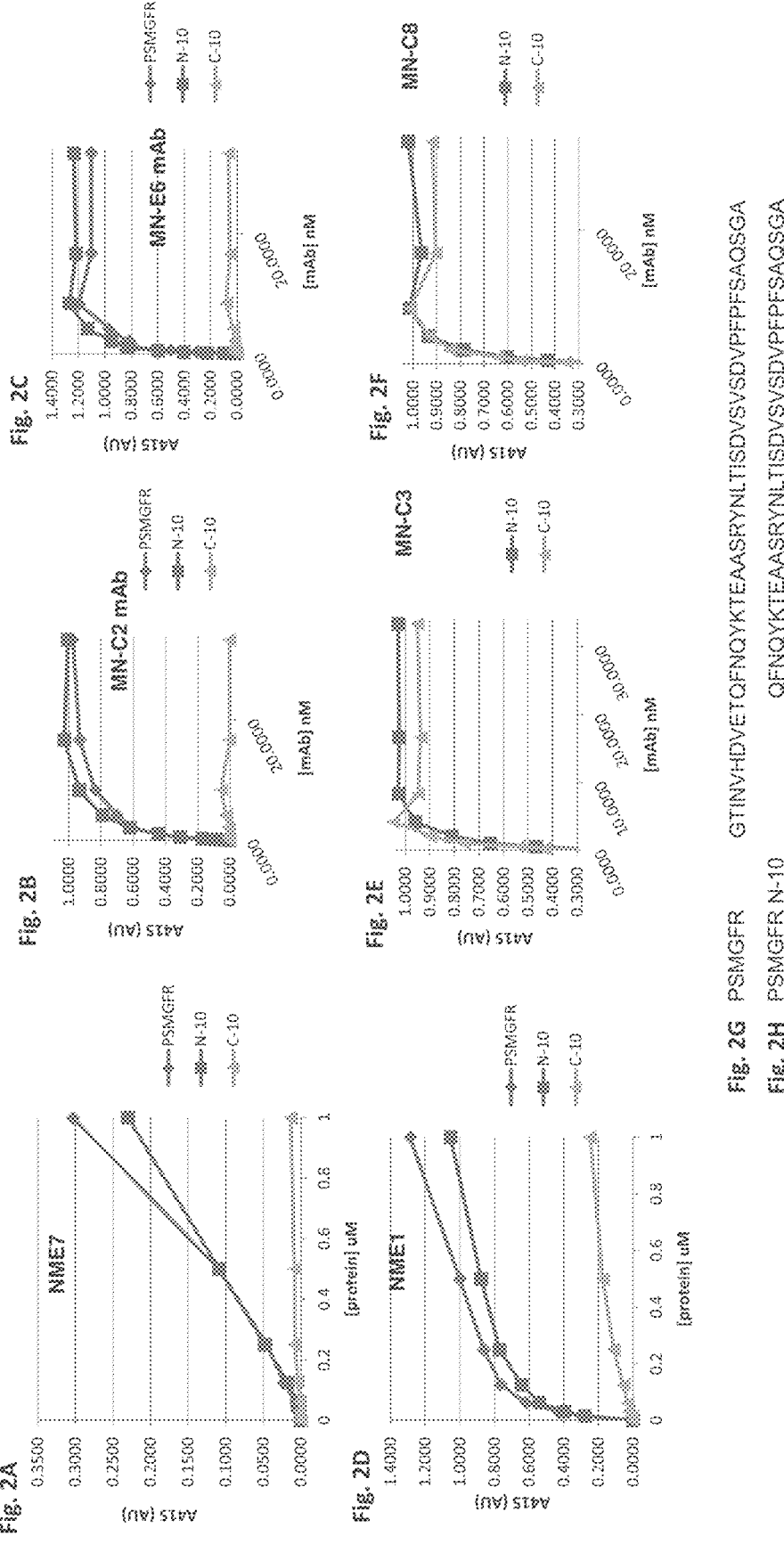
Fig. 2G  PSMGFR          GTINVHDVETQFNQYKTEAASRYNLTISDVSVSDVPFPFSAQSGA
Fig. 2H  PSMGFR N-10        OFNQYKTEAASRYNLTISDVSVSDVPFPFSAQSGA
Fig. 2I  PSMGFR C-10        GTINVHDVETQFNQYKTEAASRYNLTISDVSVSDV

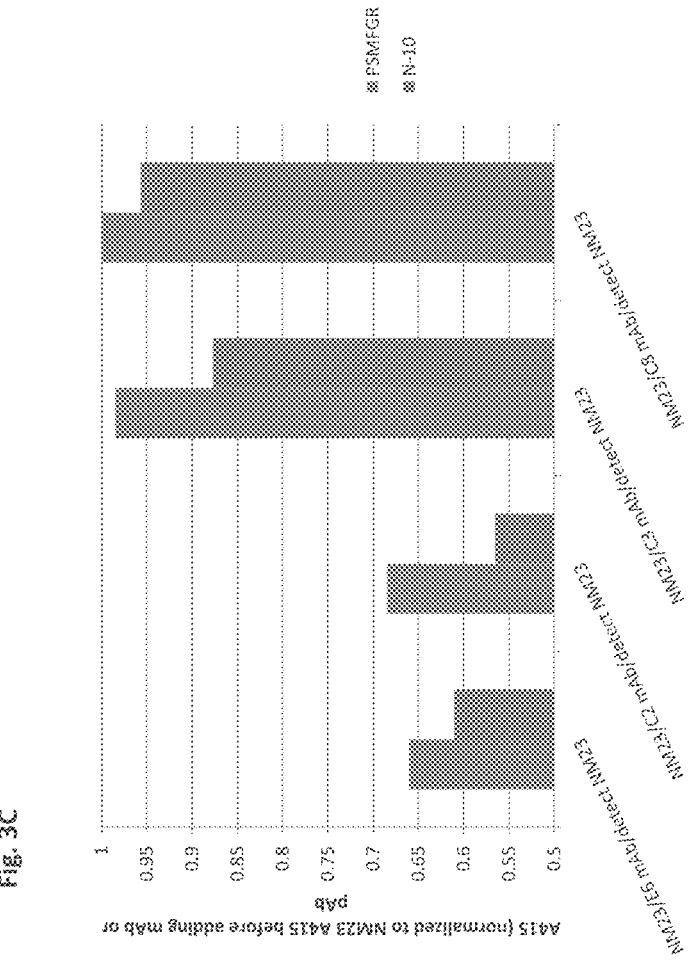
Fig. 3C
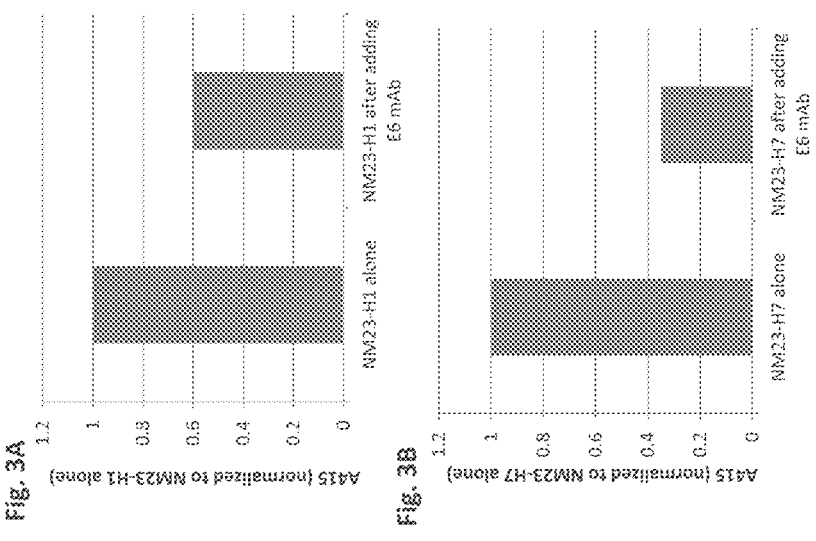
Fig. 3A
Fig. 3B

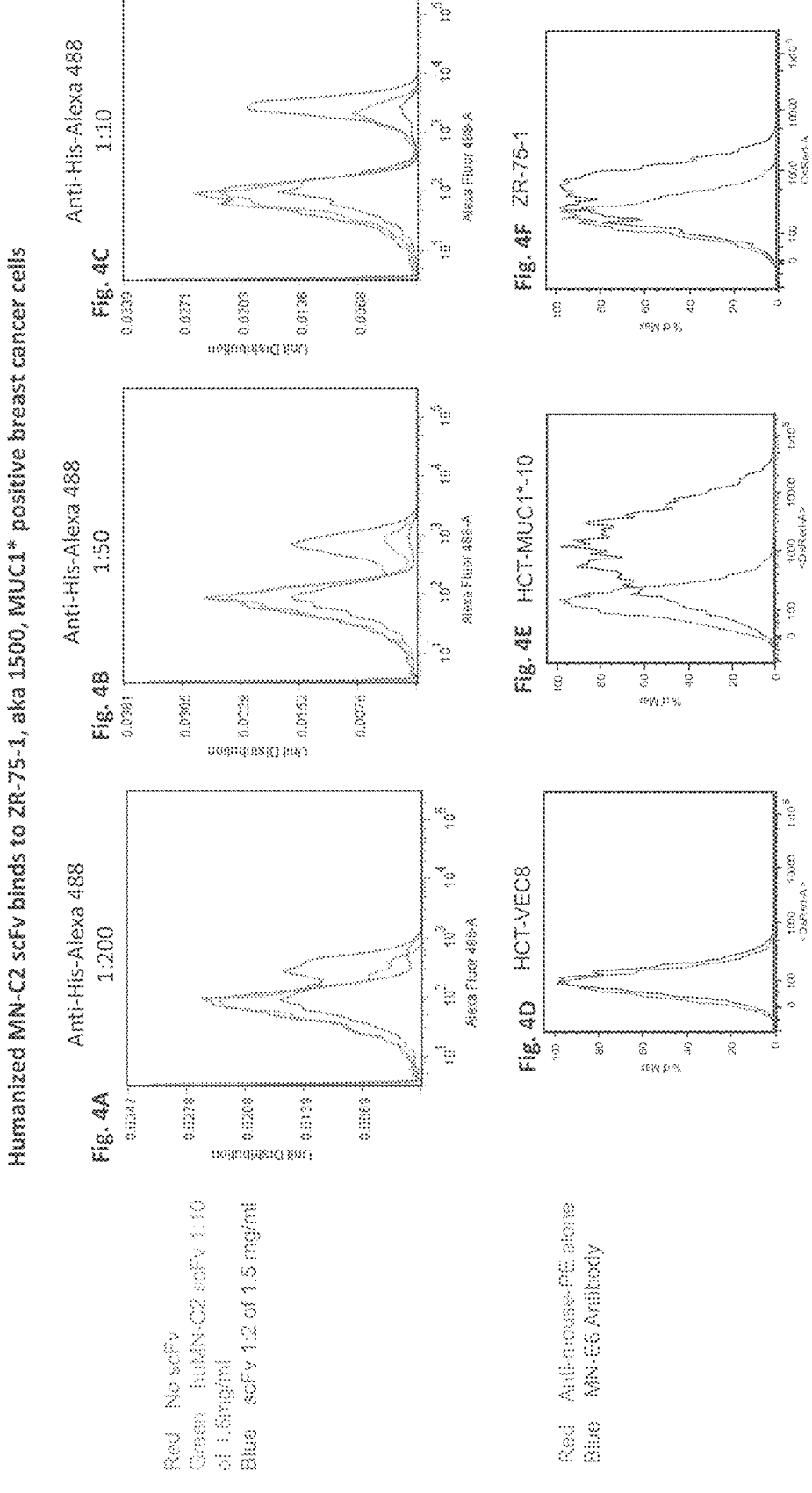
Humanized MN-C2 scFv binds to ZR-75-1, aka 1500, MUC1* positive breast cancer cells

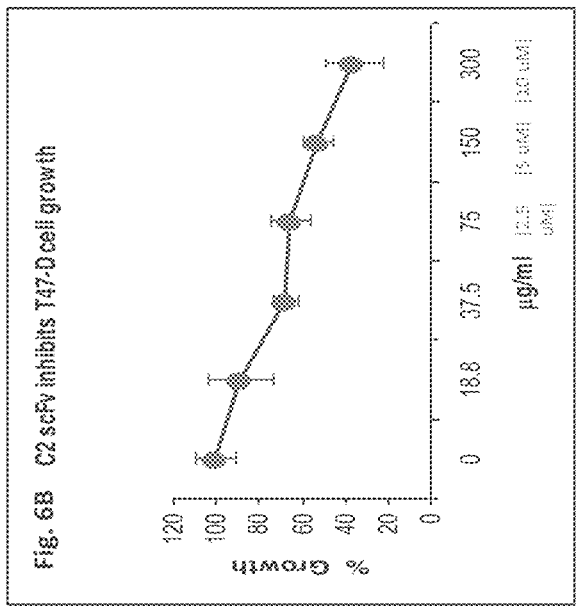
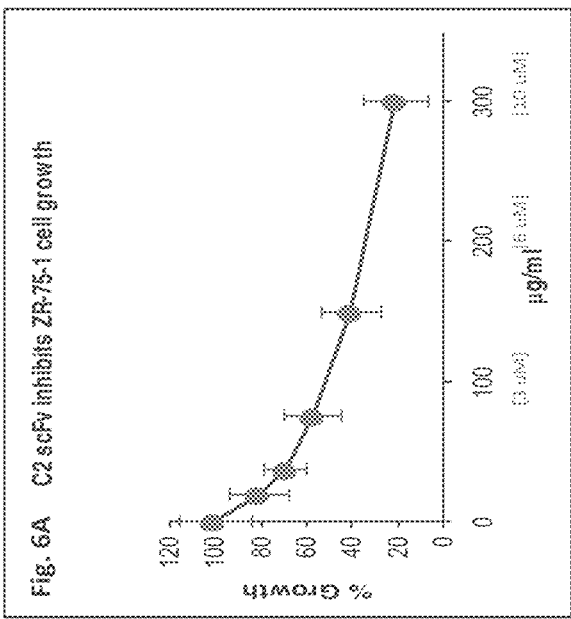

ELISA – hu MN-E6 scFv-Fc binding to MUC1* peptides PSMGFR, PSMGFR N-10 and PSMGFR C-10

ELISA – mouse monoclonal MN-C3, humanized MN-C3 and humanized MN-C3 scFv-Fc binding to MUC1* peptides PSMGFR, PSMGFR N-10 and PSMGFR C-10
Fig. 9A
Fig. 9B    Purified humanized C3 scFV-Fc
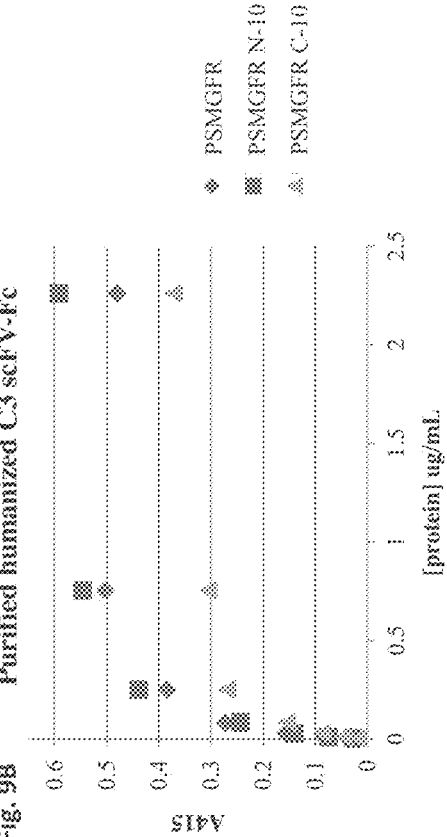

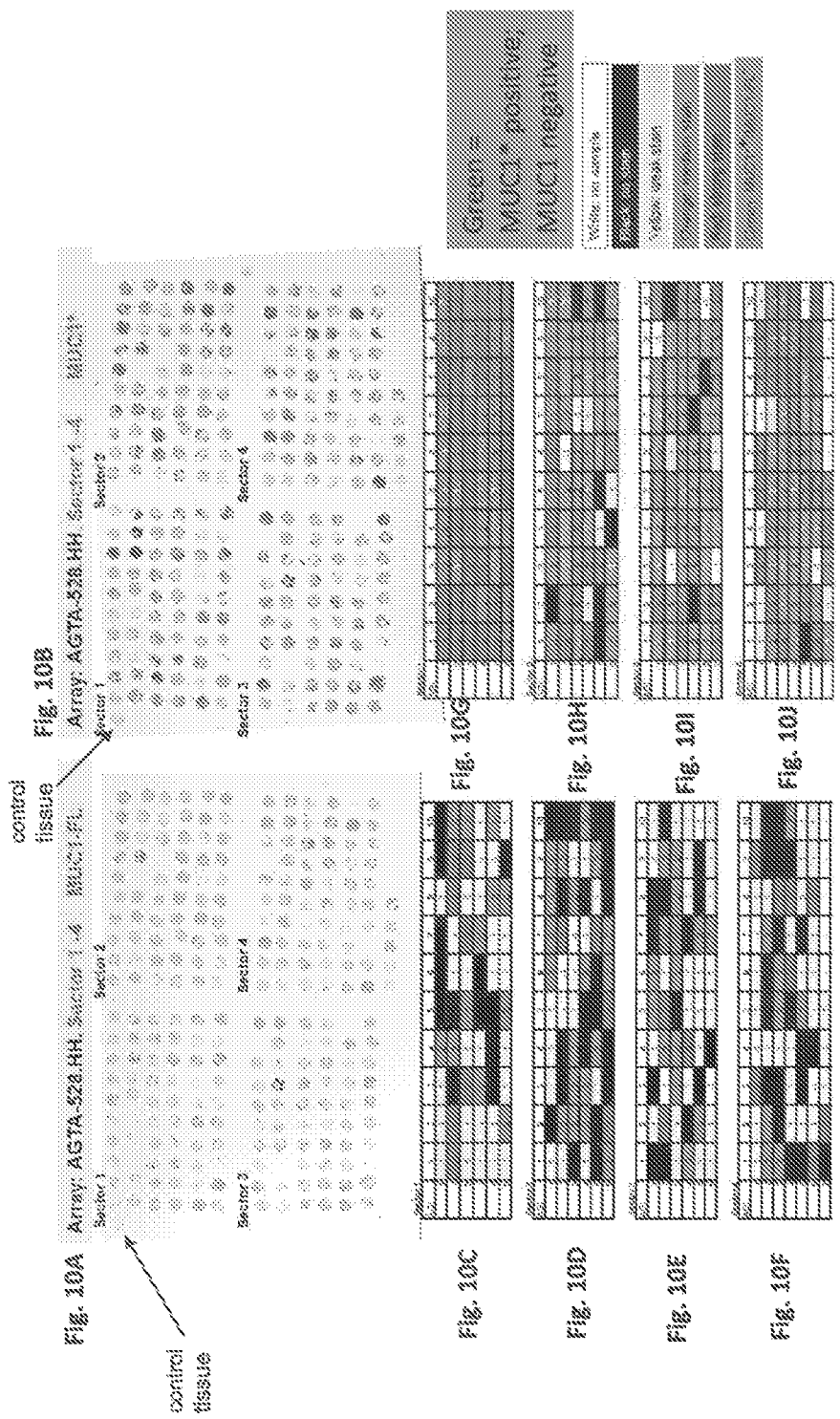

Tissue arrays comprising specimens from 240 breast cancer patients were stained with an antibody (VU4H5) that recognizes full-length MUC1 (left) or stained with an antibody that recognizes MUC1* (MN-C2). The data show that most or all (green boxes) of the MUC1 on cancerous tissue is MUC1* and not MUC1 full-length (MUC1-FL). The data further show that MN-C2 monoclonal antibody binds to cancerous tissue but not the healthy control tissue.

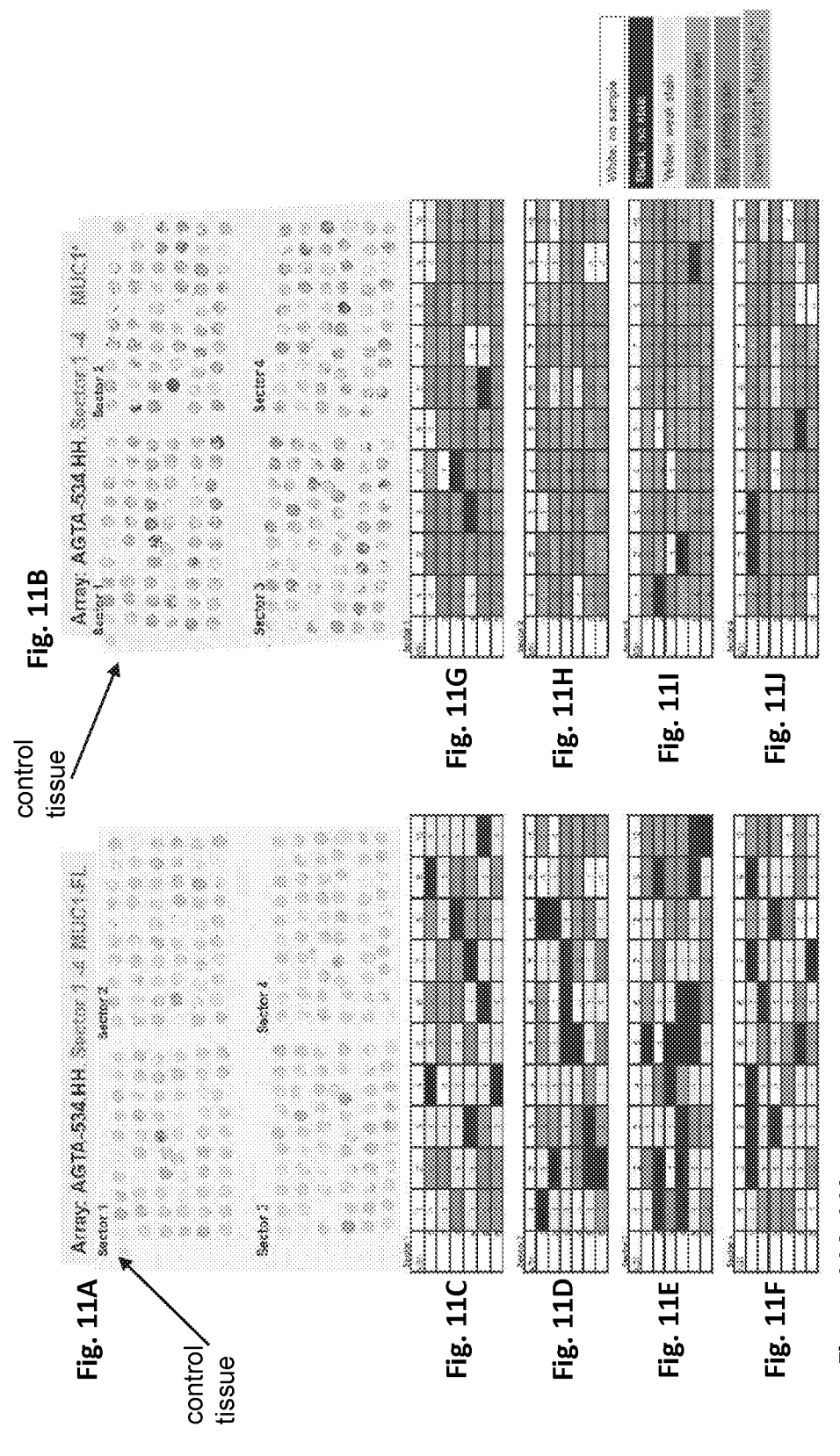

Fig. 11A

Fig. 11B control tissue

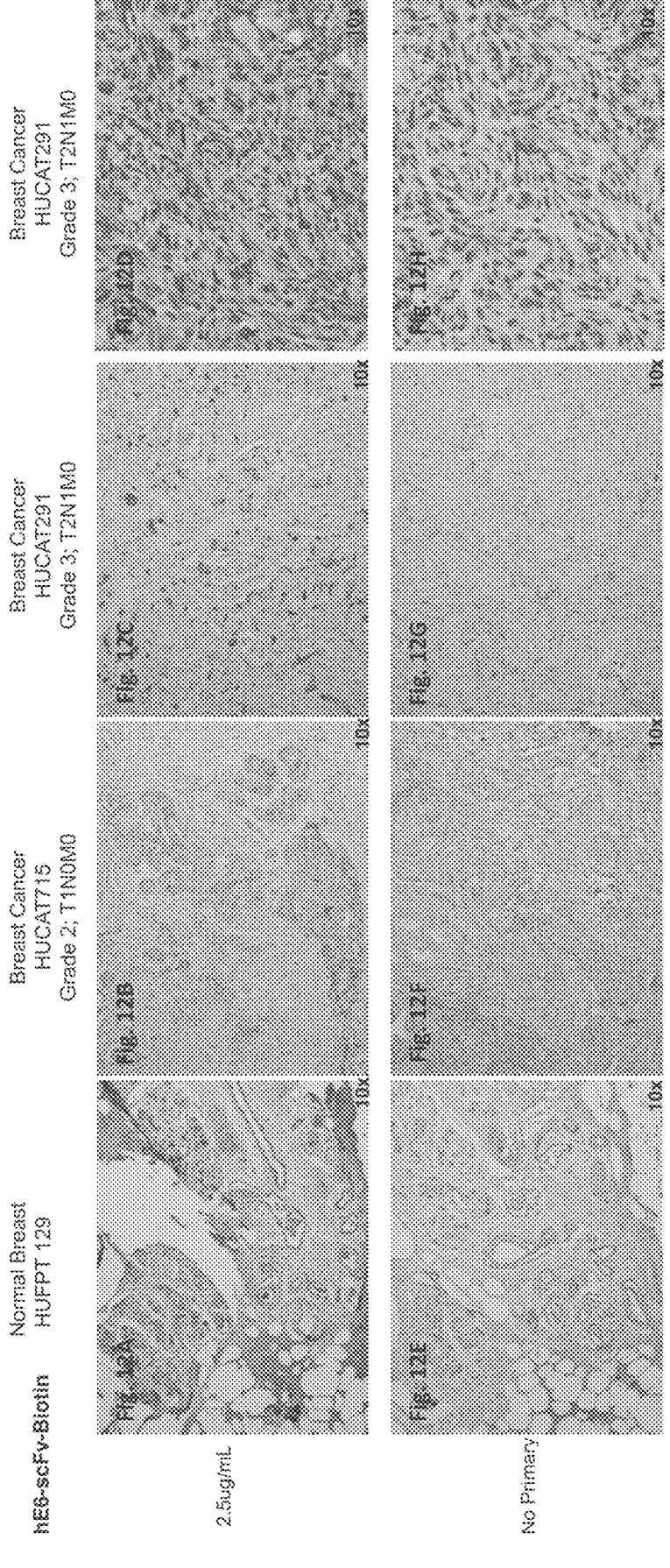

Small Intestine Normal
HUFPT081 hu-E6
scFv+Fc 50 ug/ml
2' (1:1000)

2' only control
(GaH-HRP)
1:1000

Colon Cancer
HUCAT116
Grade 1; T4N1M1 hu-E6
scFv+Fc 50 ug/ml
2' (1:1000)

2' only control
(GaH-HRP)
1:1000

Colon Cancer
HUCAT126
Grade 3; T3N1M1 hu-E6
scFv+Fc 50 ug/ml
2' (1:1000)

2' only control
(GaH-HRP)
1:1000

Prostate Cancer
HUCAT370
Grade 3; Gleason 3; 3+4 hu-E6
scFv+Fc 50 ug/ml
2' (1:750)

2' only control
(GaH-HRP)
1:750

Triple Negative Breast Cancer 85% Positive

BR487b

Antibody: MN-hC2-scFv-Fc-Biotin 50ug/mL

Negative    Focal    Score 1    Score 2    Score 3

Score/Grade
2/3 = Score 2; Grade 3

Score 2
Grade 2
T2N0M0
Invasive ductal
Carcinoma
Address C8

Score 3
Grade 3
T2N1M0
Invasive ductal
Carcinoma
Address E3

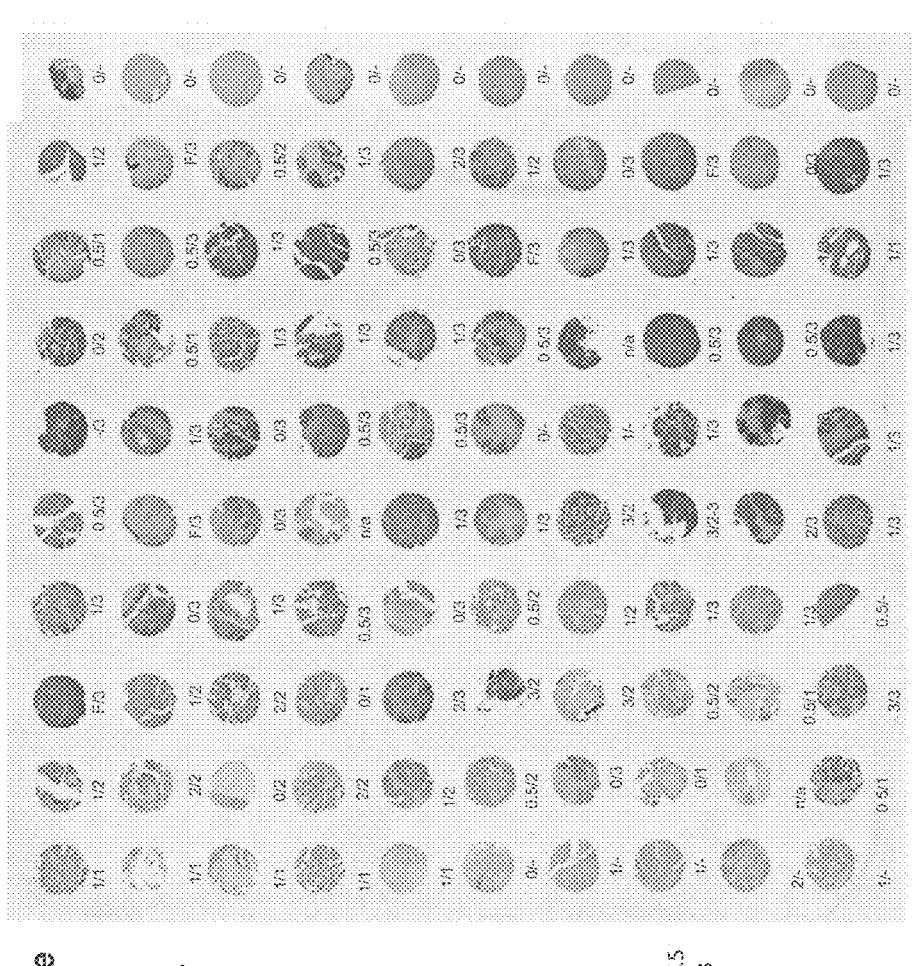
Ovarian Cancer 83% Positive
Biomax BC1115a
Antibody: MN-hC2-scFv-Fc-Biotin 50ug/mL
Fig. 31B
Fig. 31A
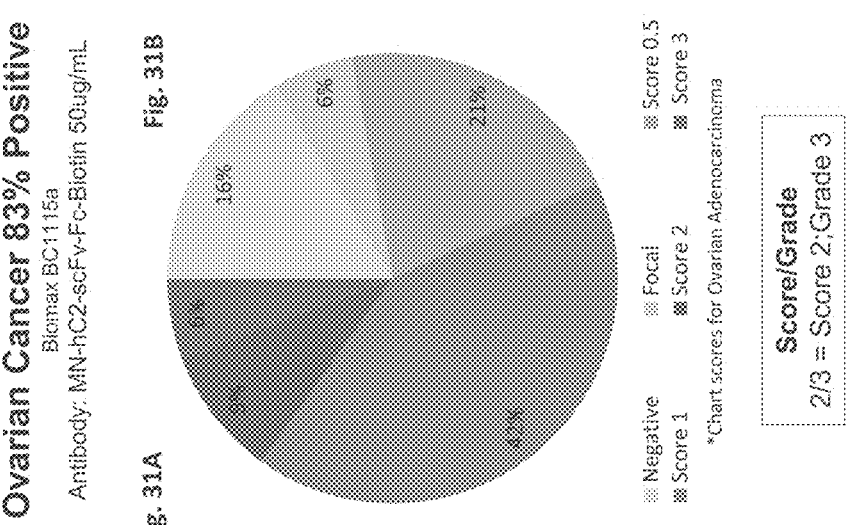
Negative    Focal    Score 0.5
Score 1    Score 2    Score 3
*Chart scores for Ovarian Adenocarcinoma
Score/Grade
2/3 = Score 2;Grade 3

Score – 3
Grade 3
T2bN0M0
Serous Papillary
Address C1

Score 2
Grade 3
T1aN0M0
Serous Papillary
Adenocarcinoma
Address C6

Pancreatic Cancer Array
Antibody: MN-hC2-scFv-Fc-Biotin 50ug/mL

Score/Grade
3/2 = Score 3; Grade 2

B1-Score 2
Grade 1
T3N0M0
Duct Adenocarcinoma

F3-Score 3
Grade 3
T2N1M0
Duct Adenocarcinoma

Lung Cancer Array
Antibody: MN-hC2-scFv-Fc-Biotin 50ug/mL

Negative      Focal       Score 0.5
Score 1       Score 2     Score 3

*Chart scores for Lung Adenocarcinoma

Score/Grade
3/2 = Score 3;Grade 2

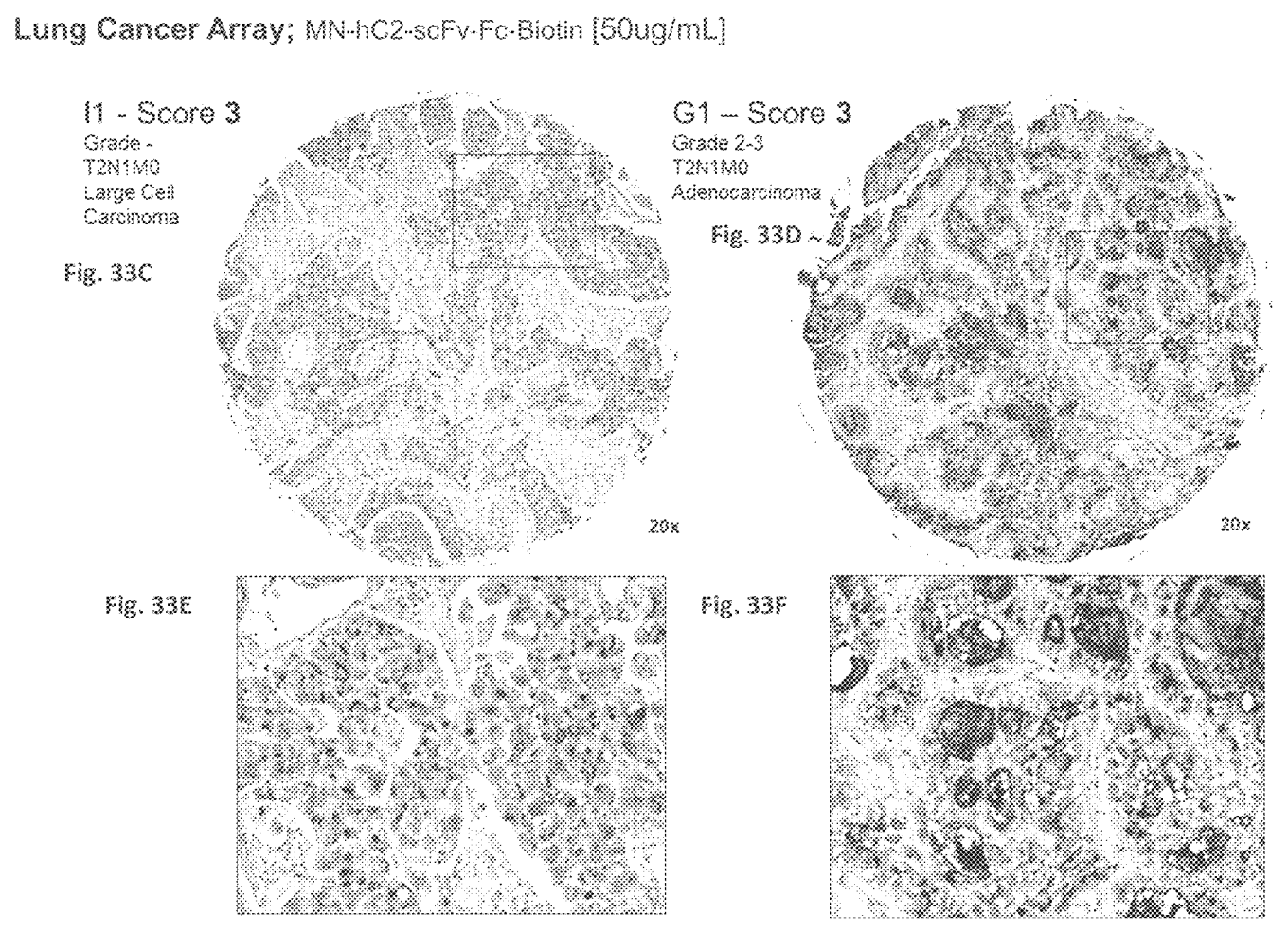

Lung Cancer Array; MN-hC2-scFv-Fc-Biotin [50ug/mL]

I1 - Score 3
Grade -
T2N1M0
Large Cell Carcinoma

Fig. 33C

G1 – Score 3
Grade 2-3
T2N1M0
Adenocarcinoma

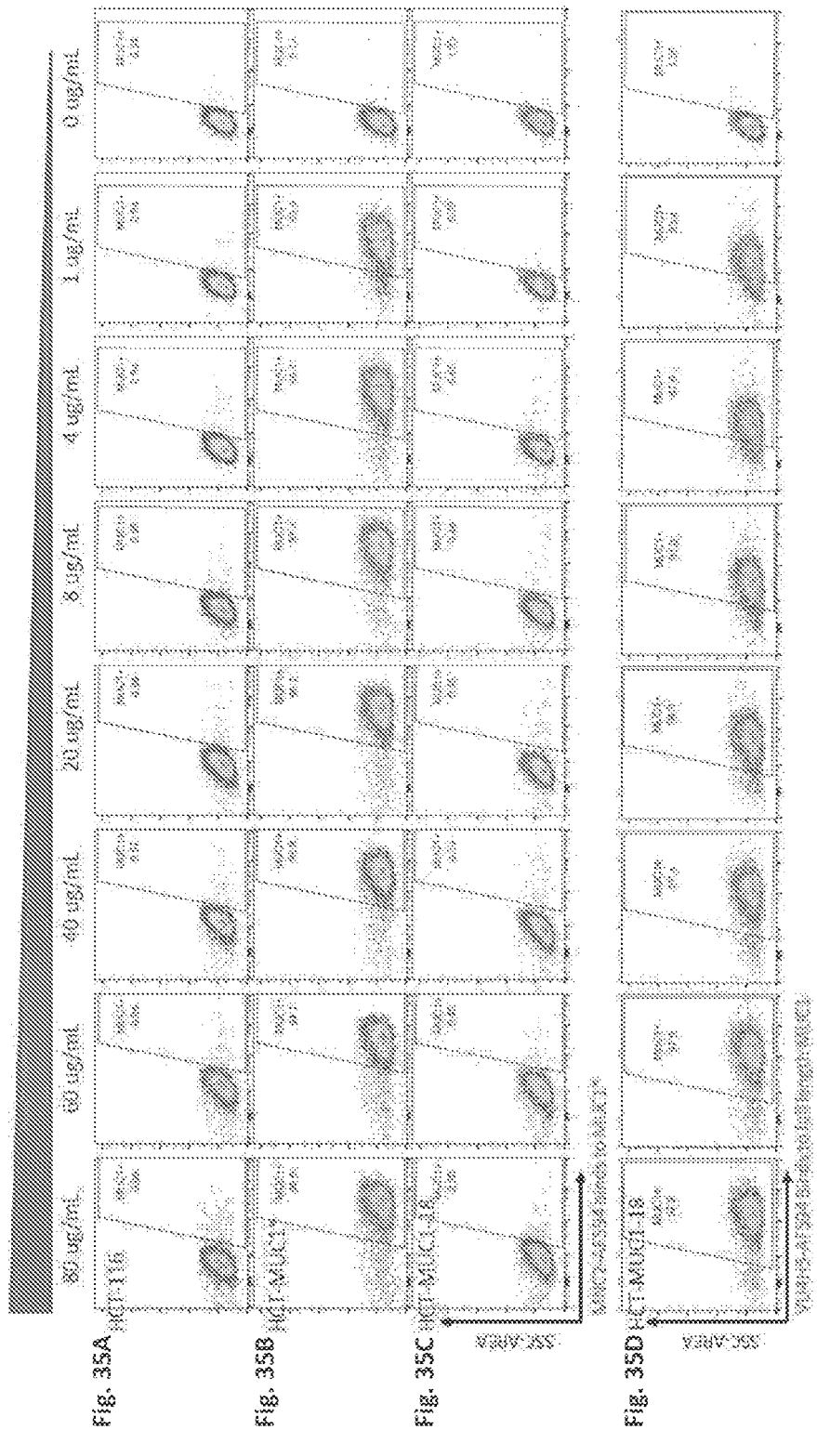
Fig. 35A HCT 116
Fig. 35B HCT-MAG1-27
Fig. 35C HCT-MAG1-3E
Fig. 35D HCT-MAG1-18

Cleavage releases tandem repeat domain; unmasks binding growth factor sites on MUC1*

MMP9 cleaves MUC1-FL to MUC1* that is recognized by MNC2

Hematopoietic stem cells express a cleaved MUC1; recognized by SDIX polyclonal & mAb MNC3 but not mAbs MNE6 or MNC2

CD34+/CD38- HSCs are positive for MNC3 but negative for MNE6

Fig. 40A    Total bone marrow cells

Fig. 40B    CD34+ cells

Fig. 40D    CD34+CD38-

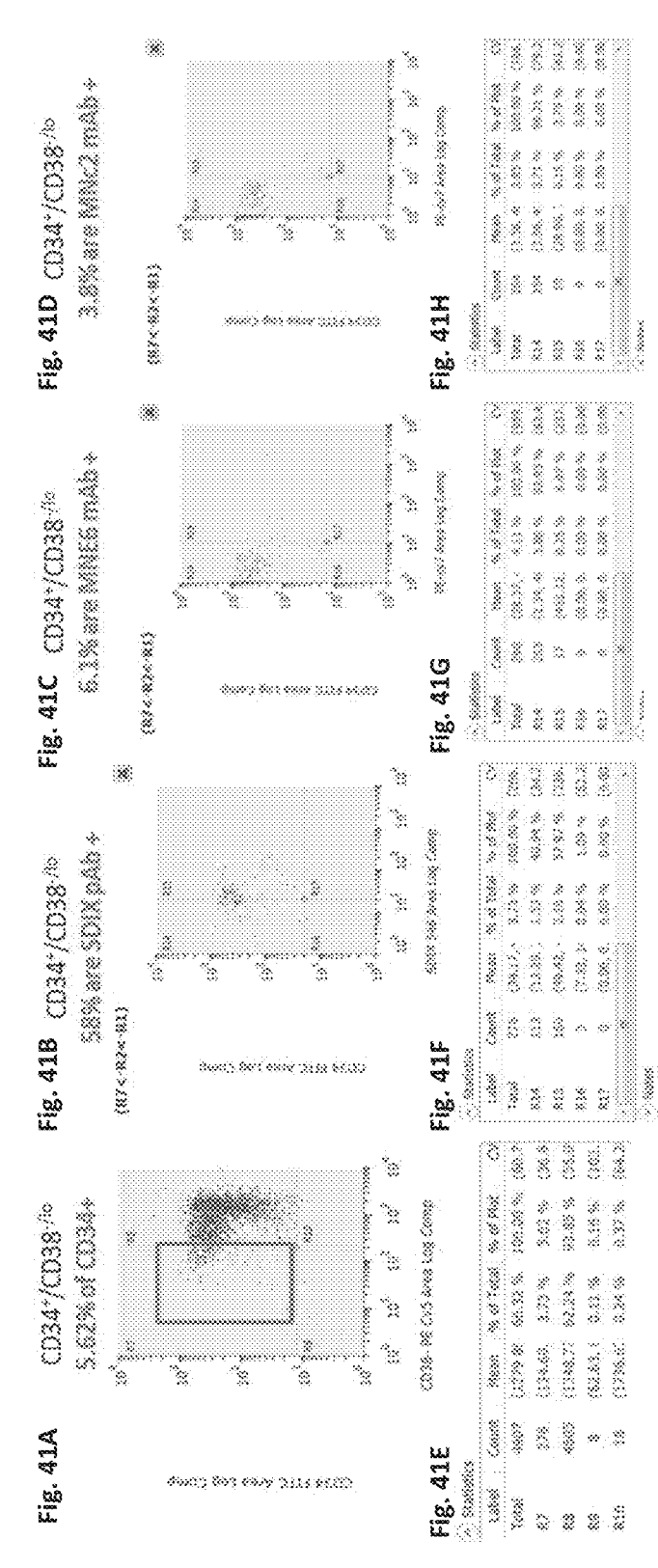
CD34+/CD38- HSCs stain positive for SDIX anti-MUC1* polyclonal, but negative for mAbs MNC2 and MNE6

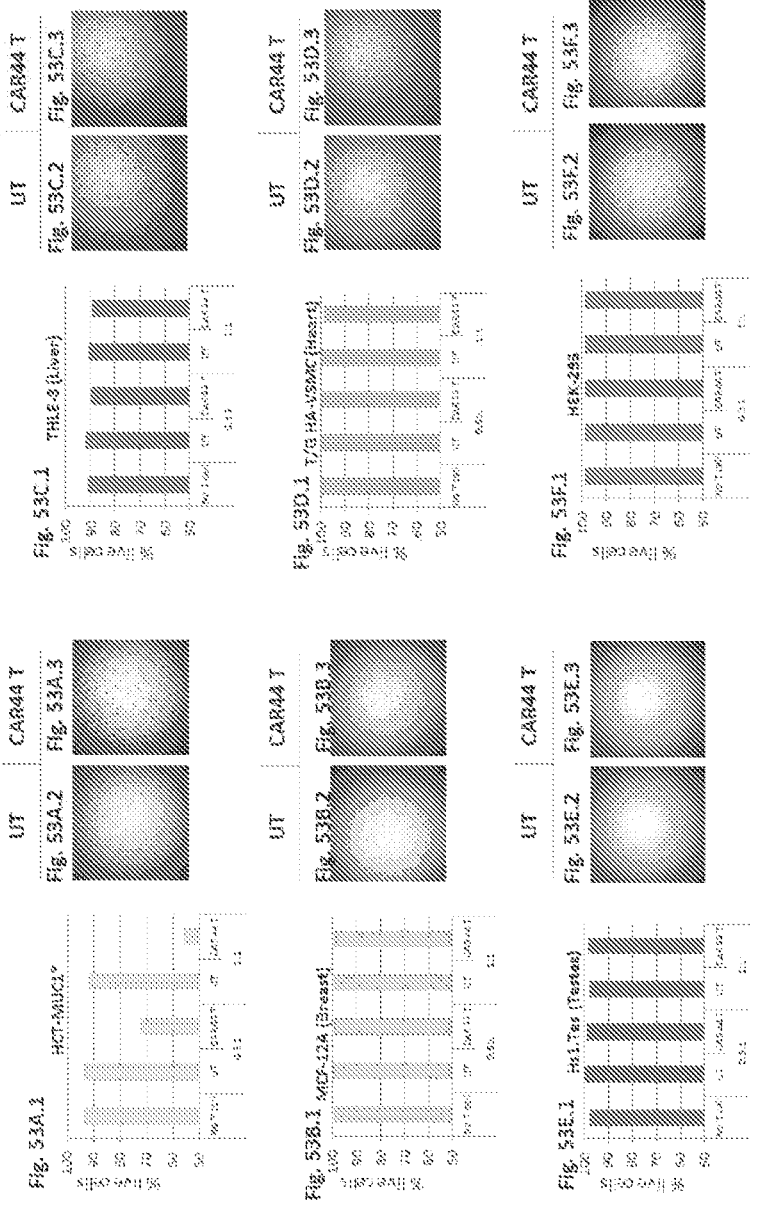

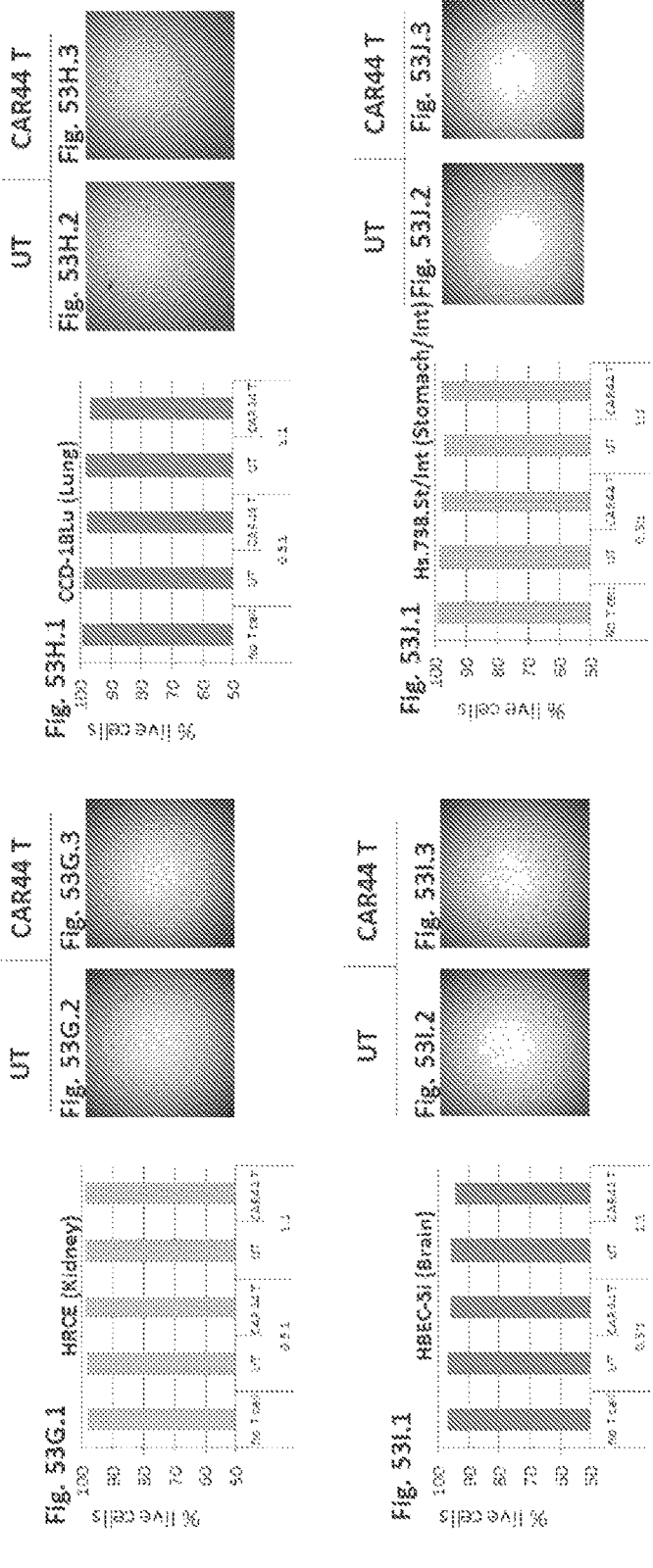

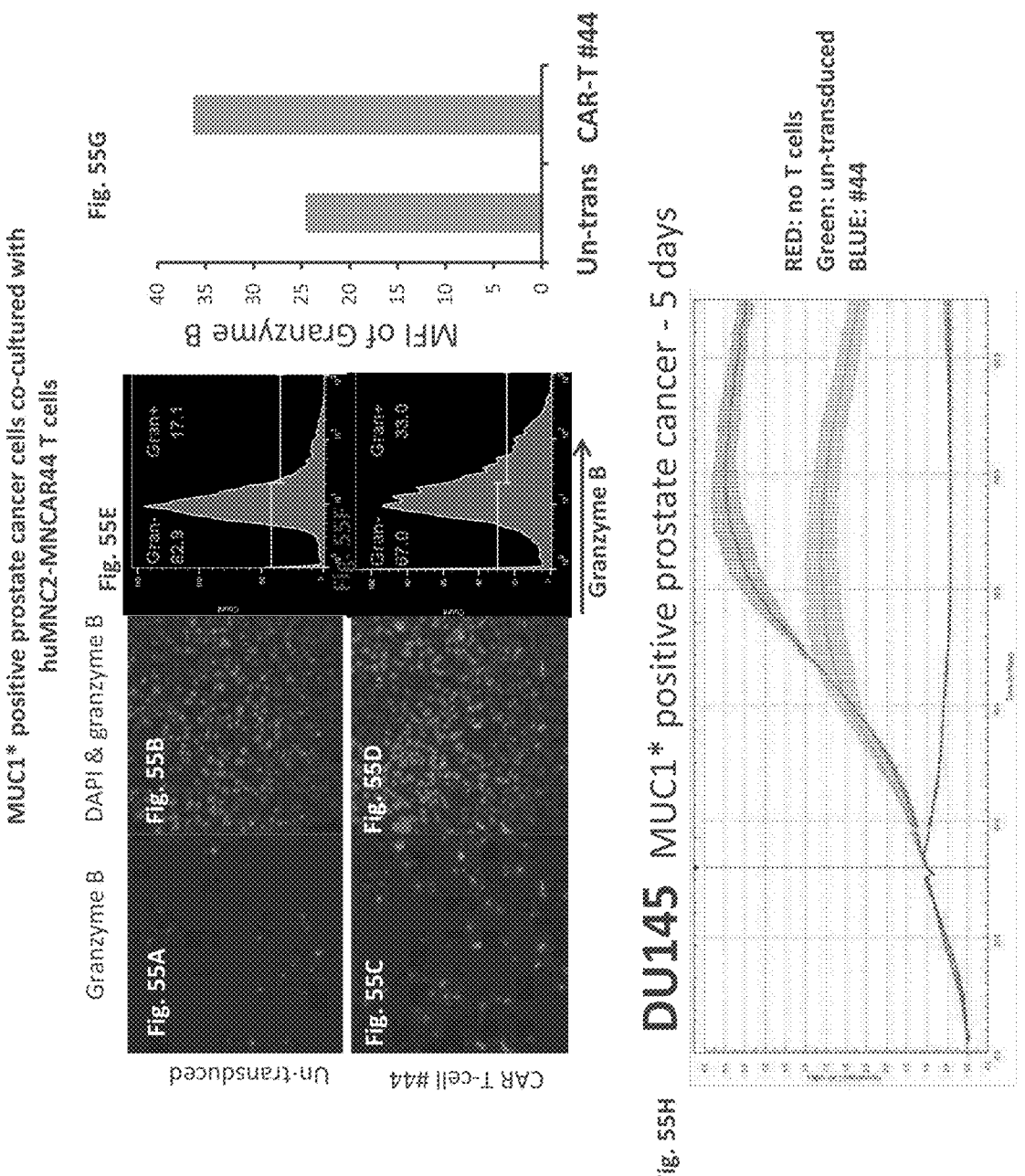

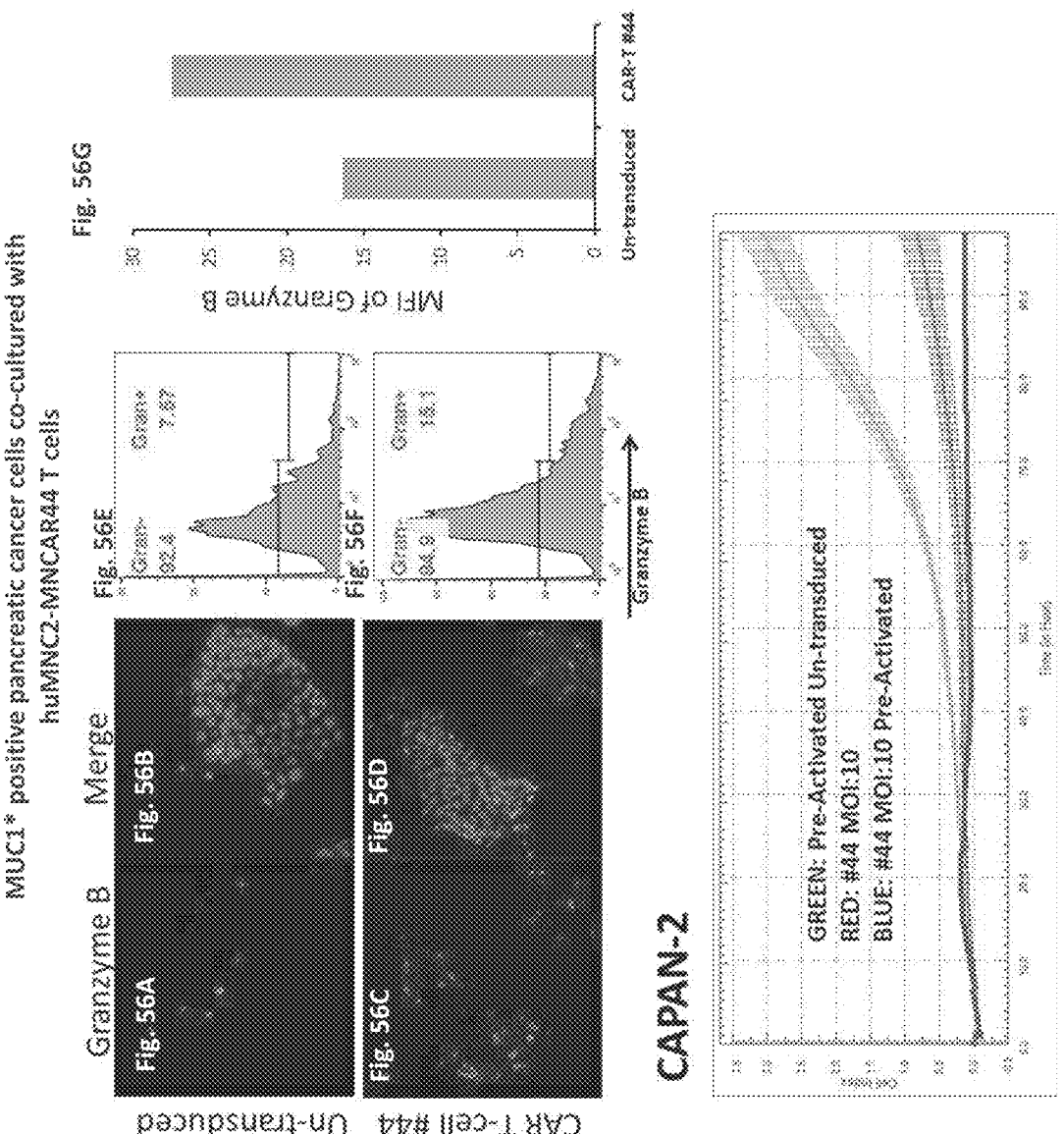

HCT-MUC1-41TR
full-length MUC1,
10-15% MUC1*
colon cancer

HCT-MUC1* colon
cancer

HCT-116 MUC1*
negative colon
cancer

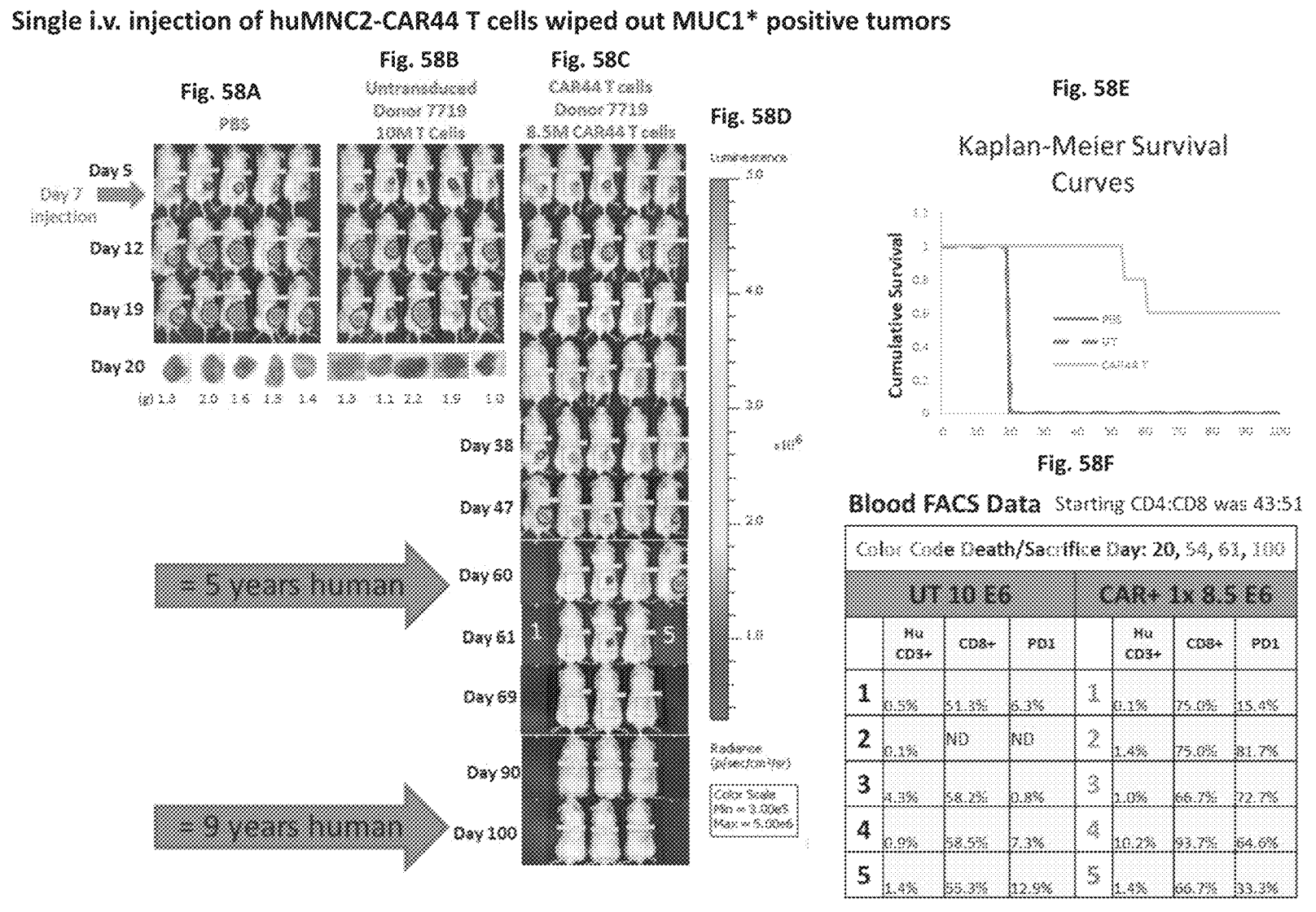

Single i.v. injection of huMNC2-CAR44 T cells wiped out MUC1* positive tumors

Fig. 58A
Fig. 58B
Fig. 58C
Fig. 58D
Fig. 58E

Kaplan-Meier Survival Curves

Fig. 58F

Blood FACS Data

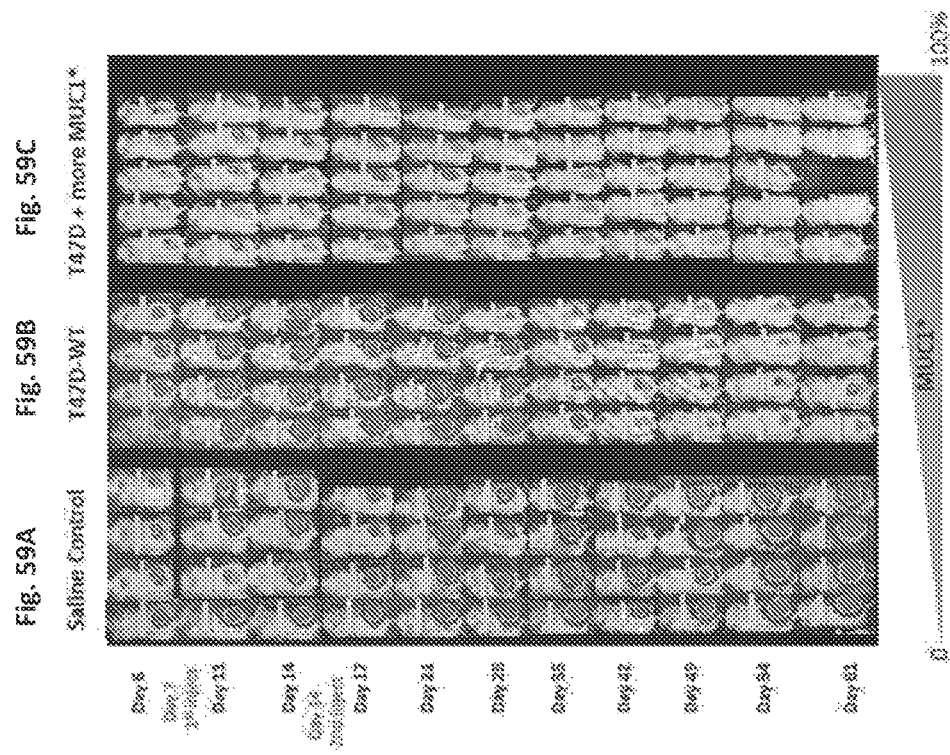

huMNC2-CAR44 T cells kill breast tumors even if only a low percentage of tumor expresses high amounts of MUC1*

Saline Control

Untransduced
T cells huMNC2-CAR44
T cells

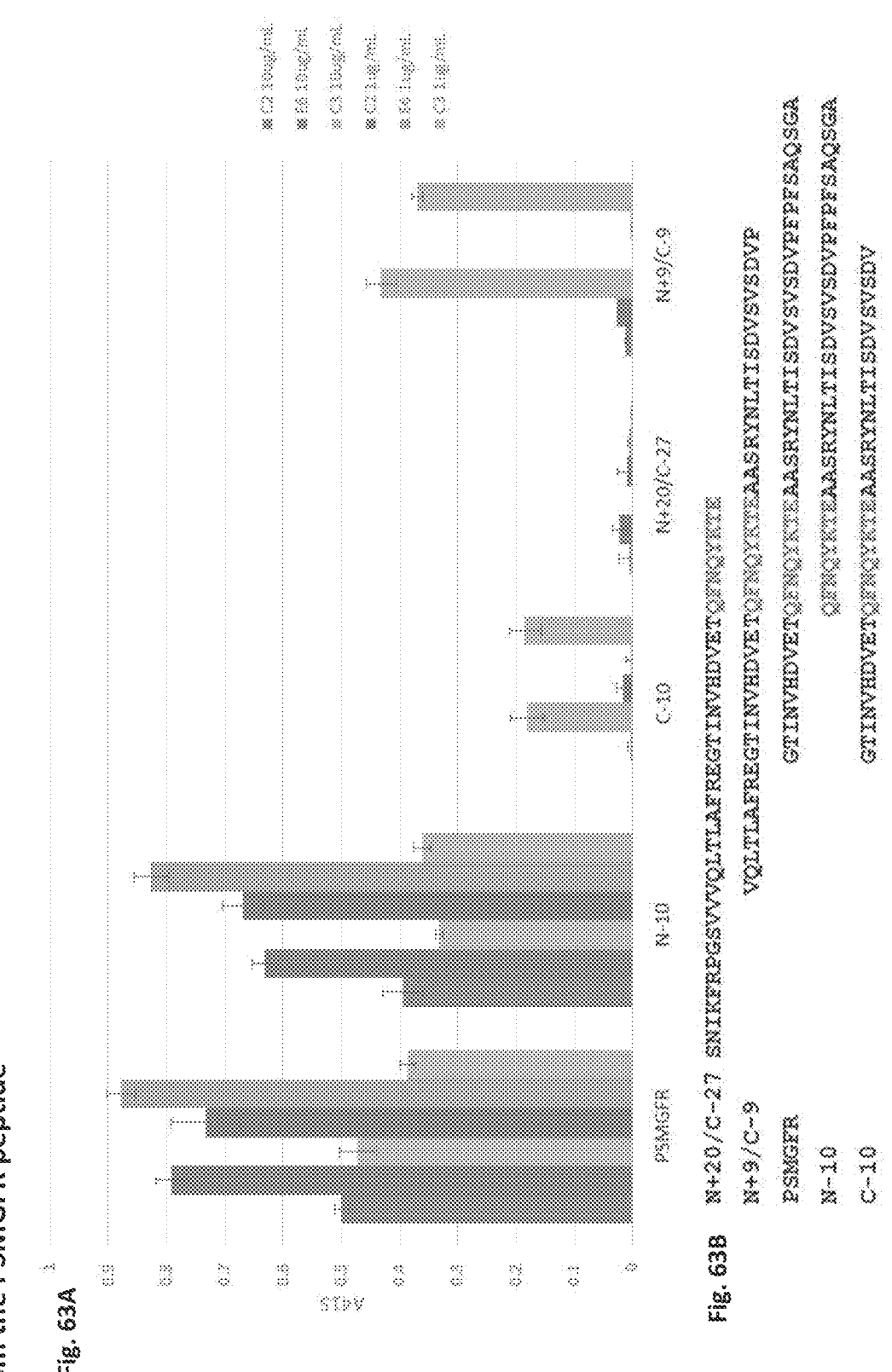

Fig. 63A

ELISA assay tests ability of monoclonal antibodies to bind to various peptides whose sequences are derived from the PSMGFR peptide

Fig. 63B

| | |
|---|---|
| N+20/C-27 | SNIKFRPGSVVVQLTLAFREGTINVHDVETQPMGTETE |
| N+9/C-9 | VQLTLAFREGTINVHDVETQPMGTETEAASRYNLTISDVSVSDVP |
| PSMGFR | GTINVHDVETQPMGYETEAASRYNLTISDVSVSDVPFPFSAQSGA |
| N-10 | QPMGYETEAASRYNLTISDVSVSDVPFPFSAQSGA |
| C-10 | GTINVHDVETQPMGYETEAASRYNLTISDVSVSDV |

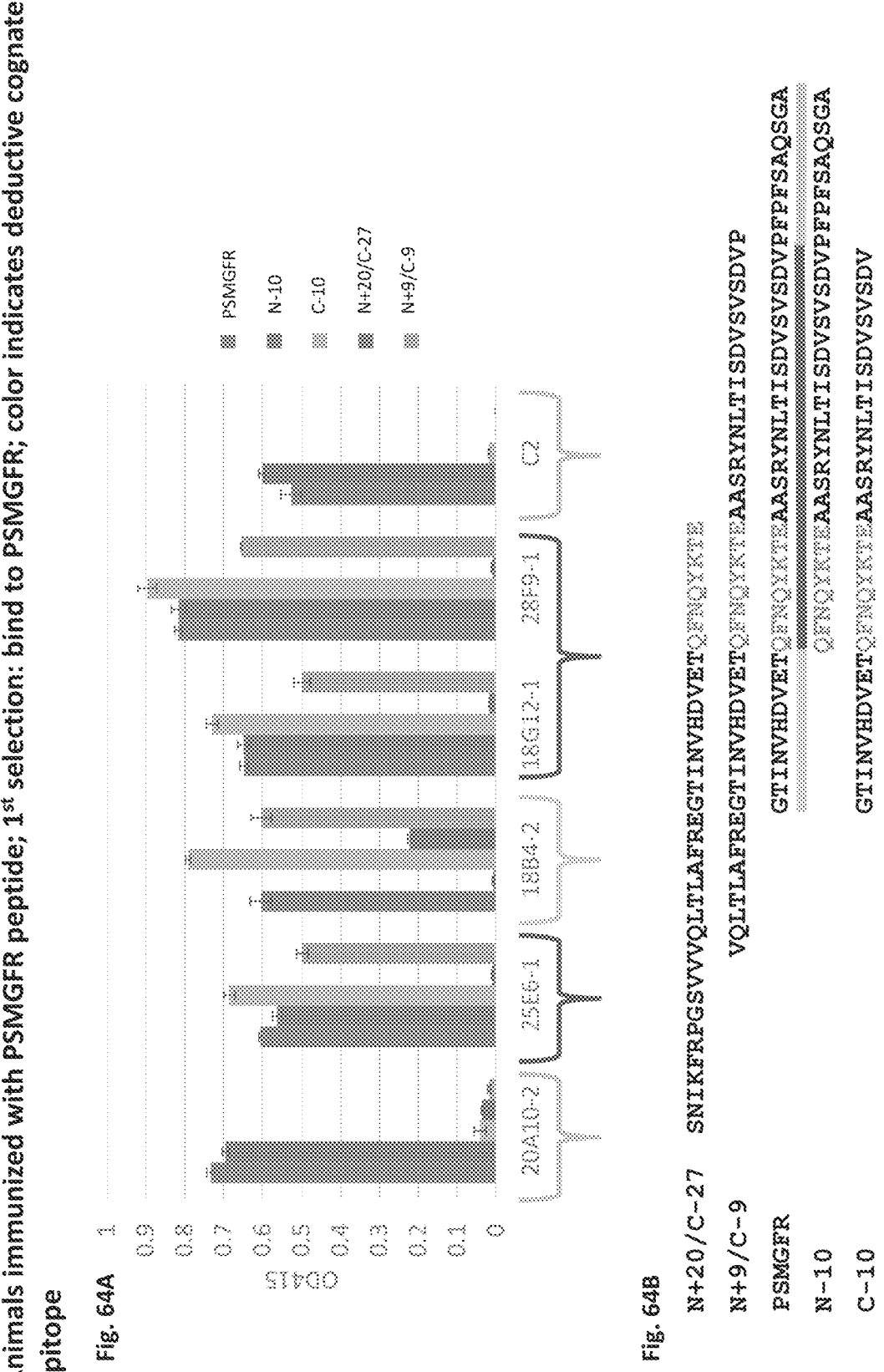

Animals immunized with PSMGFR peptide; 1st selection: bind to PSMGFR; color indicates deductive cognate epitope

| | |
|---|---|
| N+20/C-27 | SNIKFRPGSVVVQLTLAFREGTINVHDVETQFNQYKTE |
| N+9/C-9 | VQLTLAFREGTINVHDVETQFNQYKTEAASRYNLTISDVSVSDVP |
| PSMGFR | GTINVHDVETQFNQYKTEAASRYNLTISDVSVSDVPFPFSAQSGA |
| N-10 | QFNQYKTEAASRYNLTISDVSVSDVPFPFSAQSGA |
| C-10 | GTINVHDVETQFNQYKTEAASRYNLTISDVSVSDV |

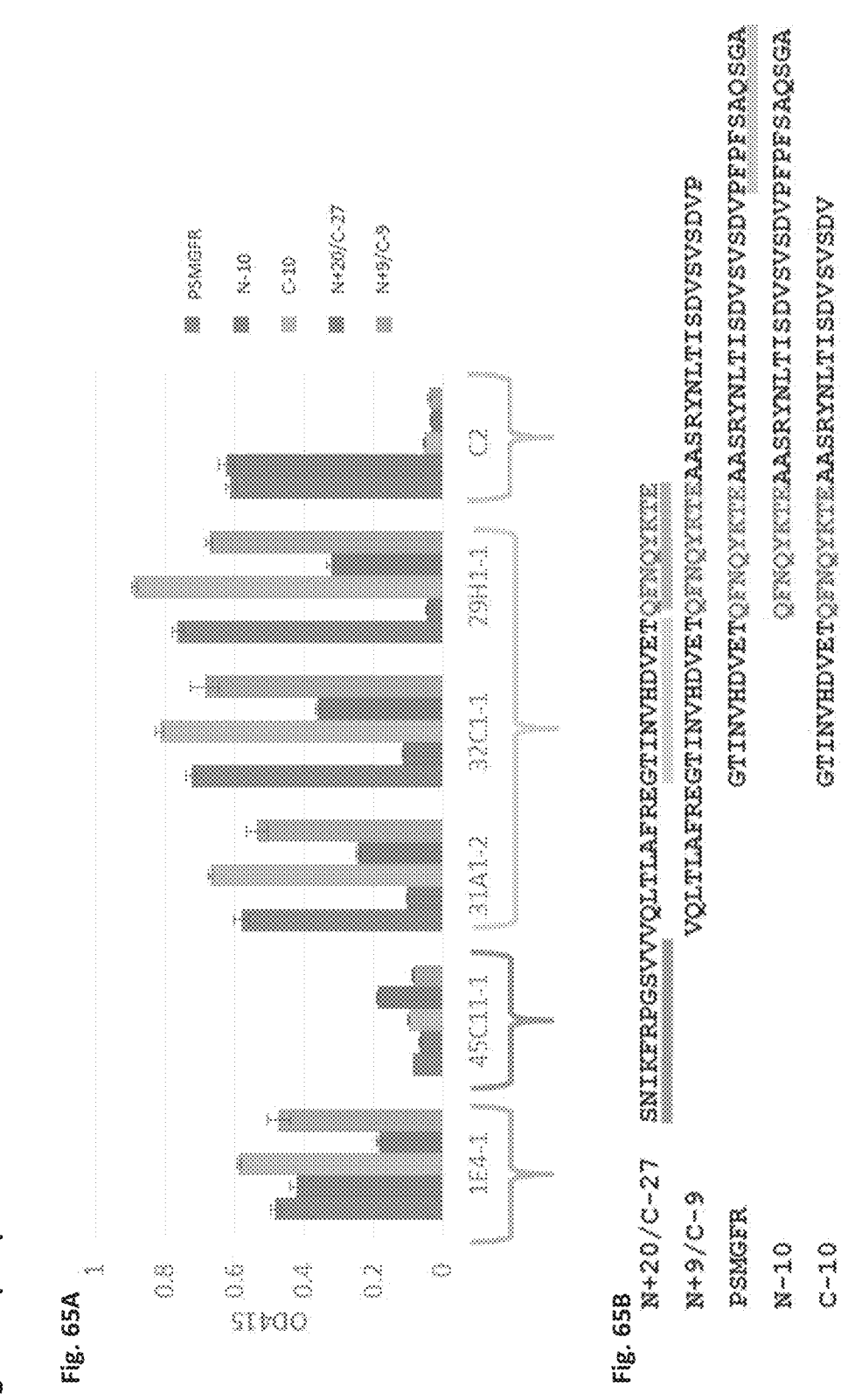
Animals immunized with N+20/C-27 peptide; 1st selection: binds to N+20/C-27; color indicates deductive cognate epitope Animals immunized with 9+C-9 peptide; 1st selection: bind to 9+C-9; color indicates deductive cognate epitope

| | |
|---|---|
| N+20/C-27 | SNIKFRPGSVVVQLTLAFREGTINVHDVETQFMQXXIIE |
| N+9/C-9 | VQLTLAFREGTINVHDVETQFMQXTEAASRYNLTISDVSVSDVP |
| PSMGFR | GTINVHDVETQFMQXTEAASRYNLTISDVSVSDVPFPFSAQSGA |
| N-10 | QFMQXTEAASRYNLTISDVSVSDVPFPFSAQSGA |
| C-10 | GTINVHDVETQFMQXTEAASRYNLTISDVSVSDV |

ELISA: PSMGFR antibodies -- refined epitope mapping (all antibodies @10ug/mL)

Fig. 67A

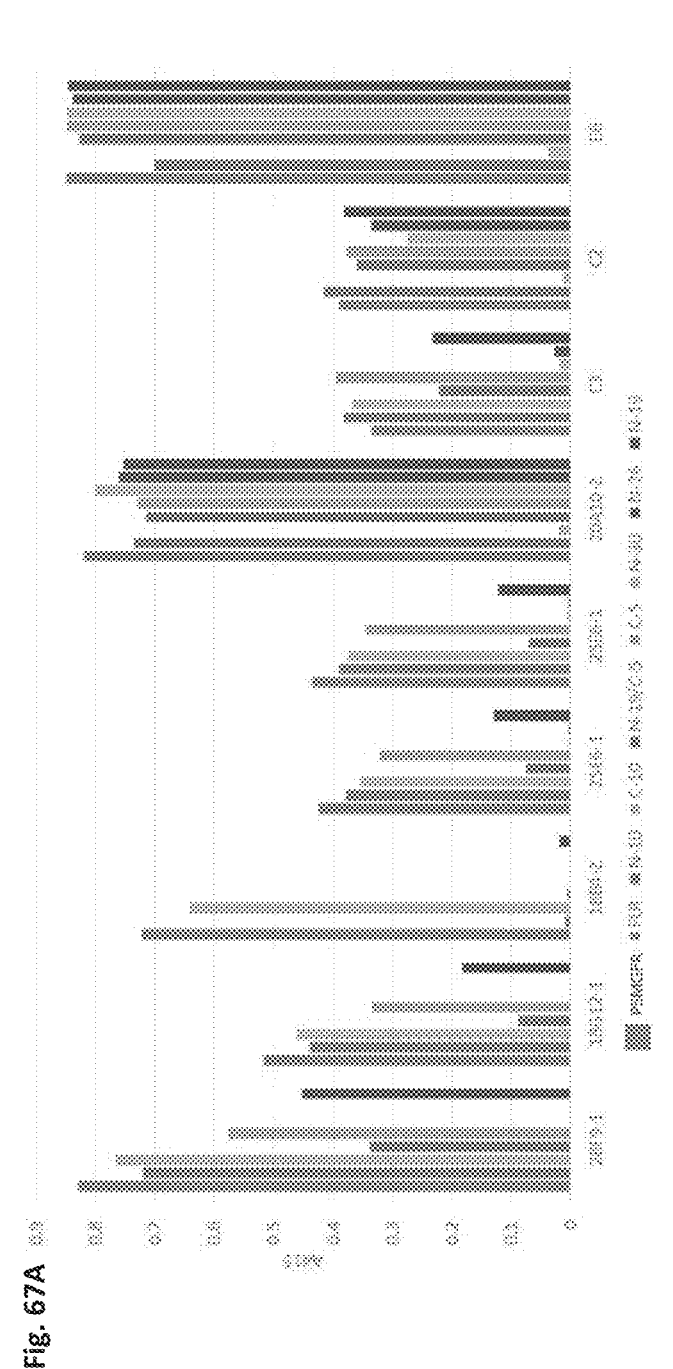

Fig. 67B　SNIKFRPGSVVVQLTLAFREGTINVHDVETQFNQYKTEAASRYNLTISDVSVSDVPFFFSAQSGA

Fig. 67C

N-19　　　　　　　　　　　　　　　　　　　　　　ASRYNLTISDVSVSDVPFFFSAQSGA
N-26　　　　　　　　　　　　　　　　　　　　　　　ISDVSVSDVPFFFSAQSGA
N-30　　　　　　　　　　　　　　　　　　　　　　　　SVSDVPFFFSAQSGA
N-10/C-5　　　　　　　　　QFNQYKTEAASRYNLTISDVSVSDVPFFFS----
N-19/C-5　　　　　　　　　　　　　　ASRYNLTISDVSVSDVPFFFS----
PSMGFR　　　　　　　　　GTINVHDVETQFNQYKTEAASRYNLTISDVSVSDVPFFFSAQSGA
N-10　　　　　　　　　　　QFNQYKTEAASRYNLTISDVSVSDVPFFFSAQSGA
C-10　　　　　　　　GTINVHDVETQFNQYKTEAASRYNLTISDVSVSDV-----------

Fig. 67D

Refined epitope

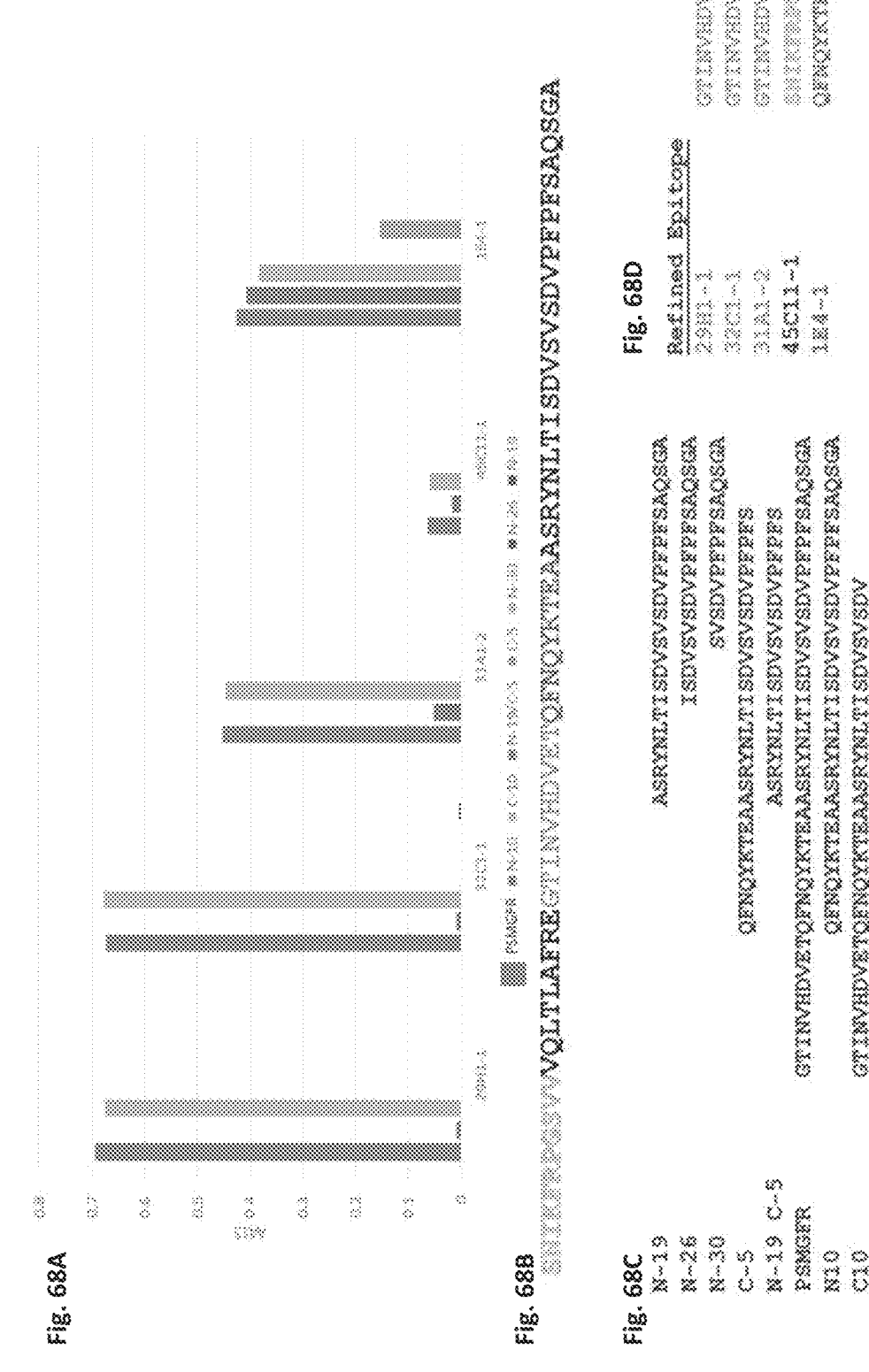
ELISA: N+20/C-27 antibodies – refined epitope mapping (all antibodies @10ug/mL)

ELISA displacement assay tests ability of antibodies of the invention to displace NME7$_{AB}$ from binding to PSMGFR peptide.

SNIRRPPSSVVVQLTLAFREGTINVHDVETQFNQVKTEAASWMLTISDVSVSDVPFPFSAQSGA

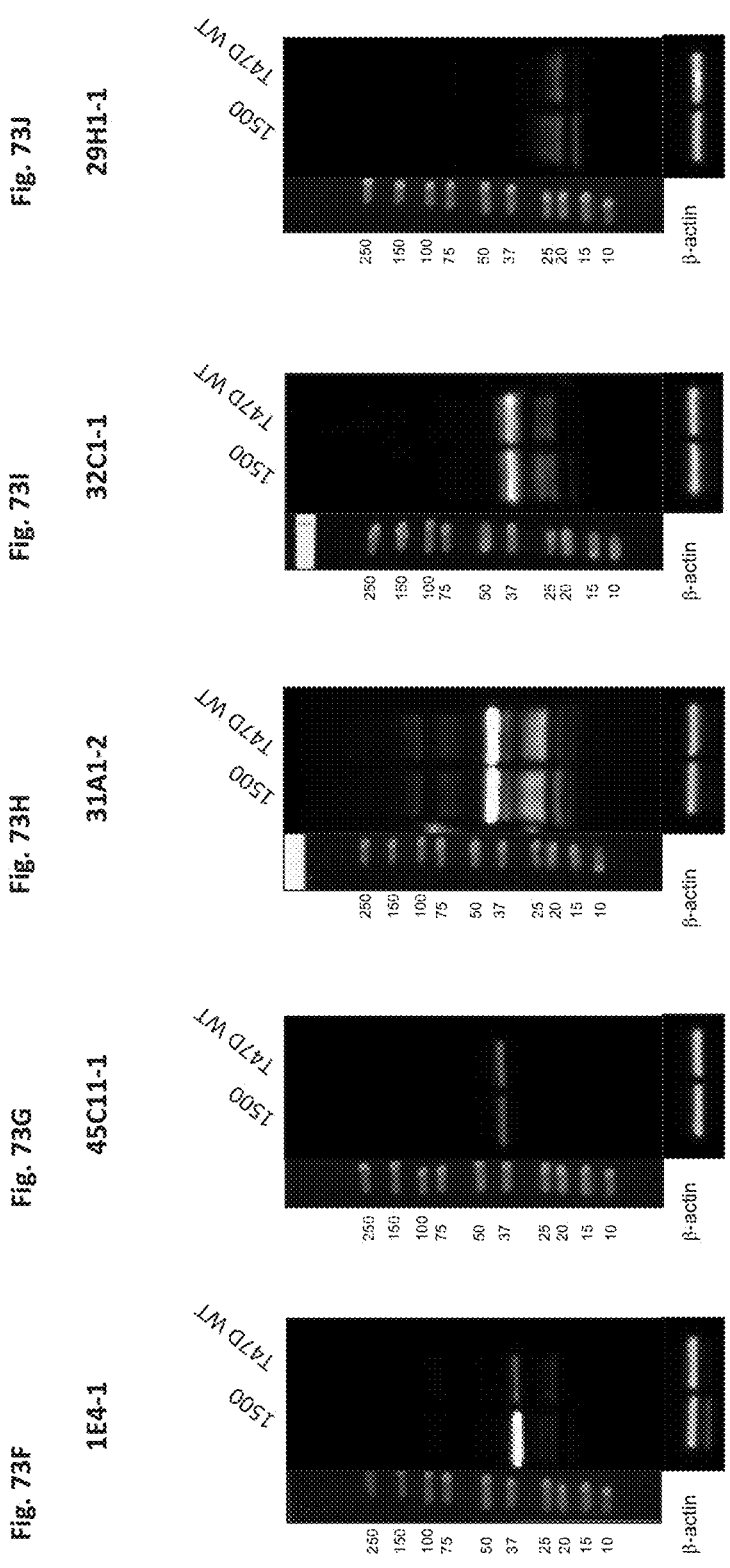
Figure 73F--73J

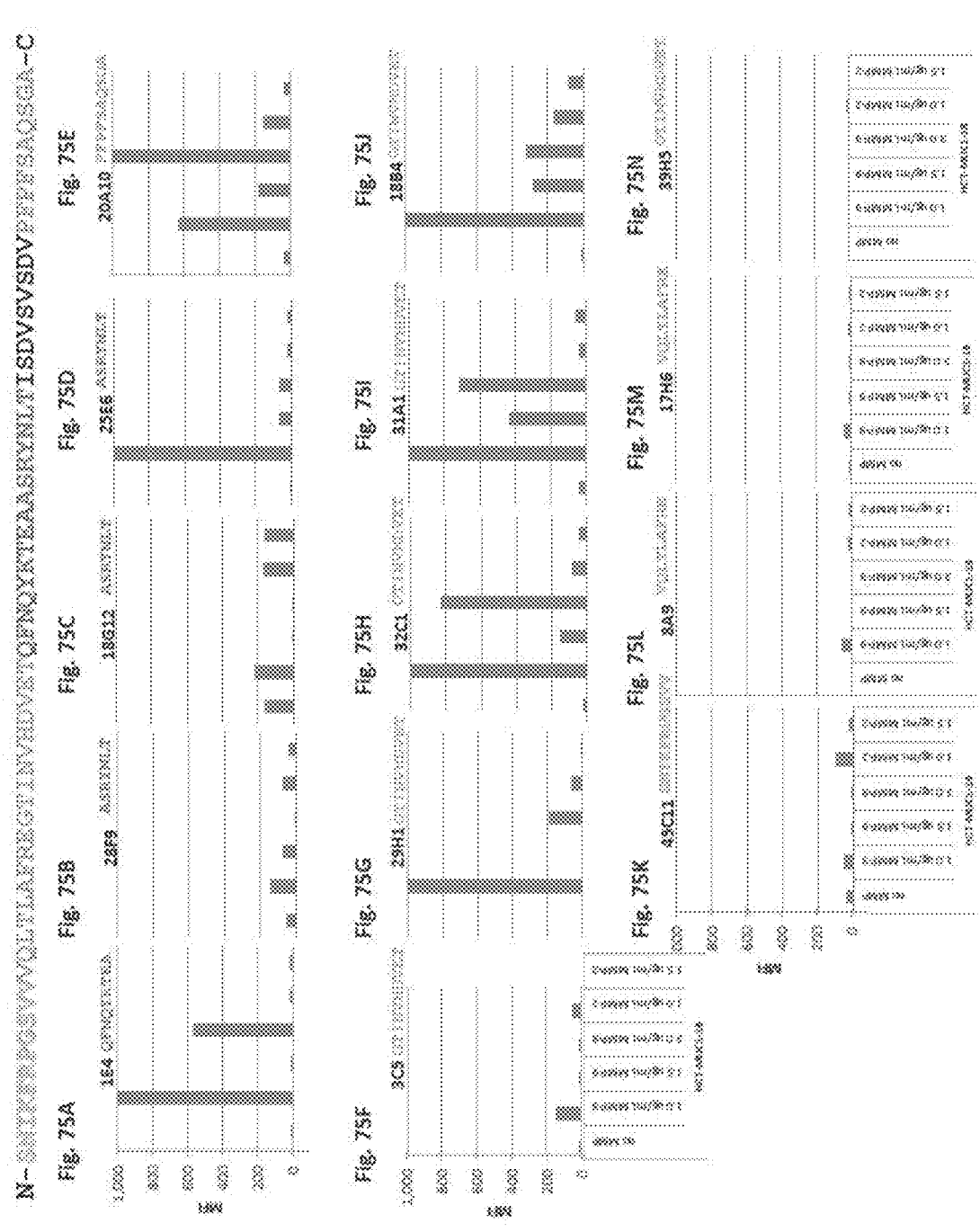

N- SNKKFRPGSNV VQLTLAFRE GTNVHDVET QFNQYKTEA ASRYNLT ISDVSVSDV PFPFSAQSGA -C

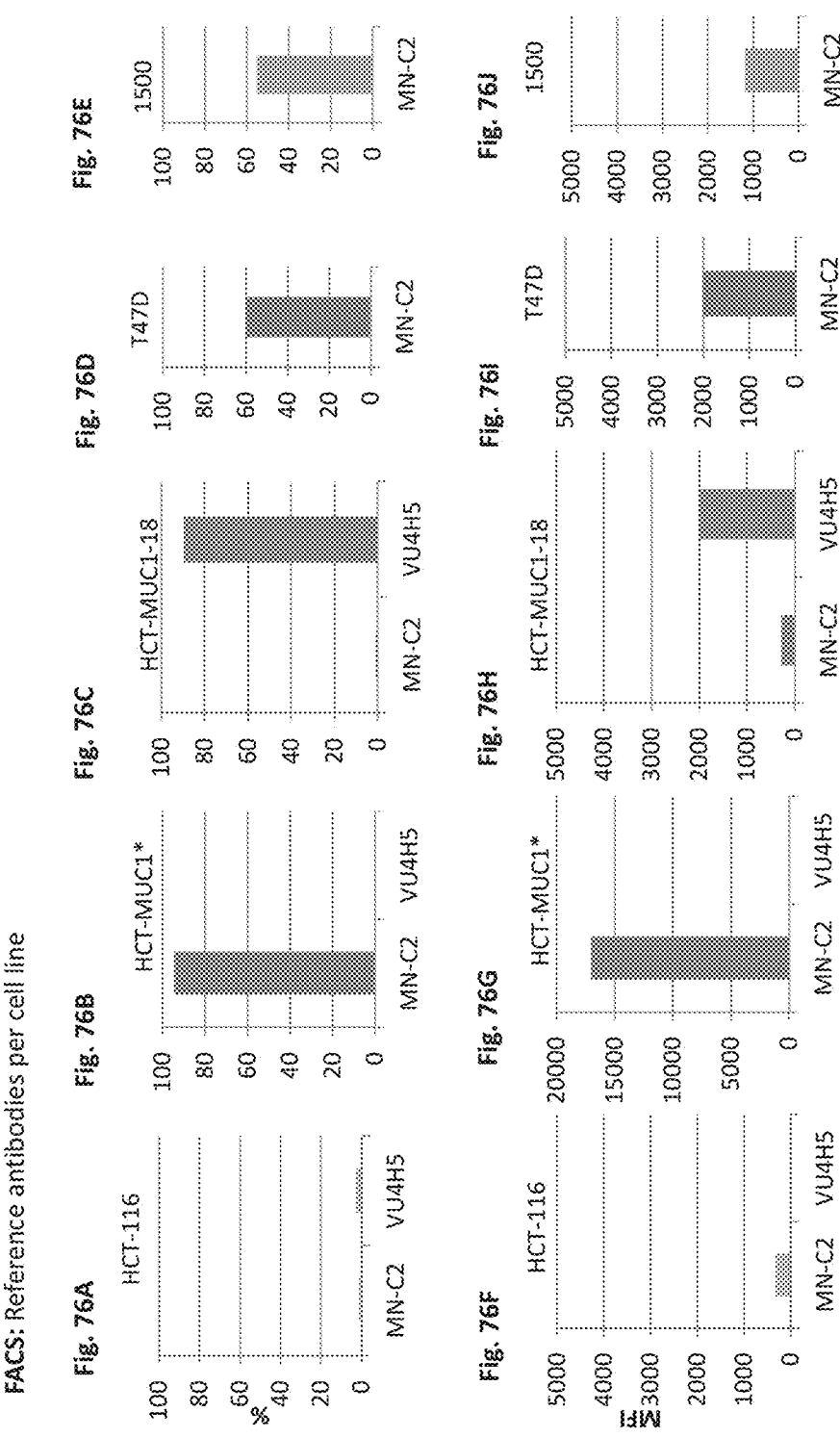
FACS: Reference antibodies per cell line

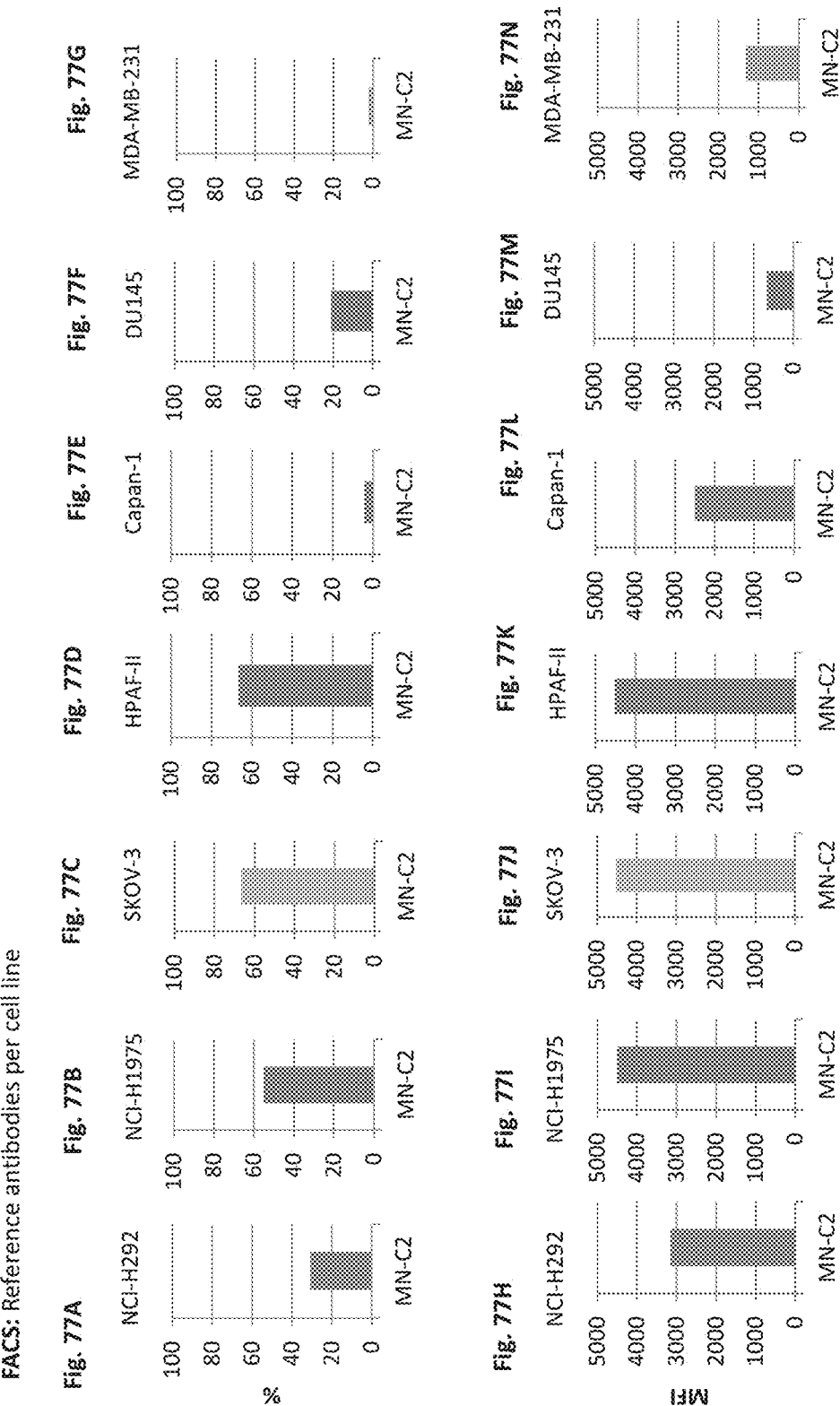
FACS: Reference antibodies per cell line

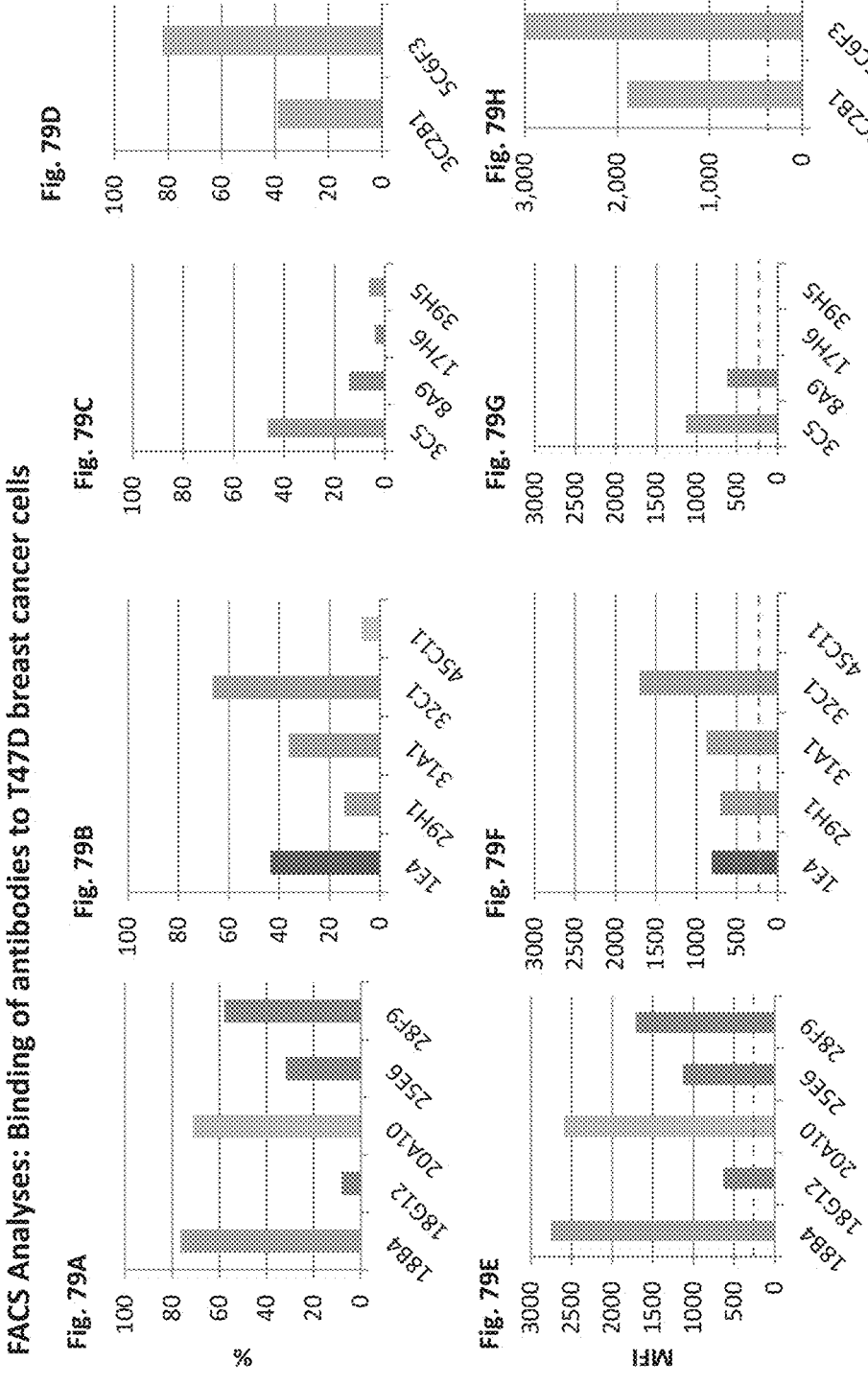
FACS Analyses: Binding of antibodies to T47D breast cancer cells

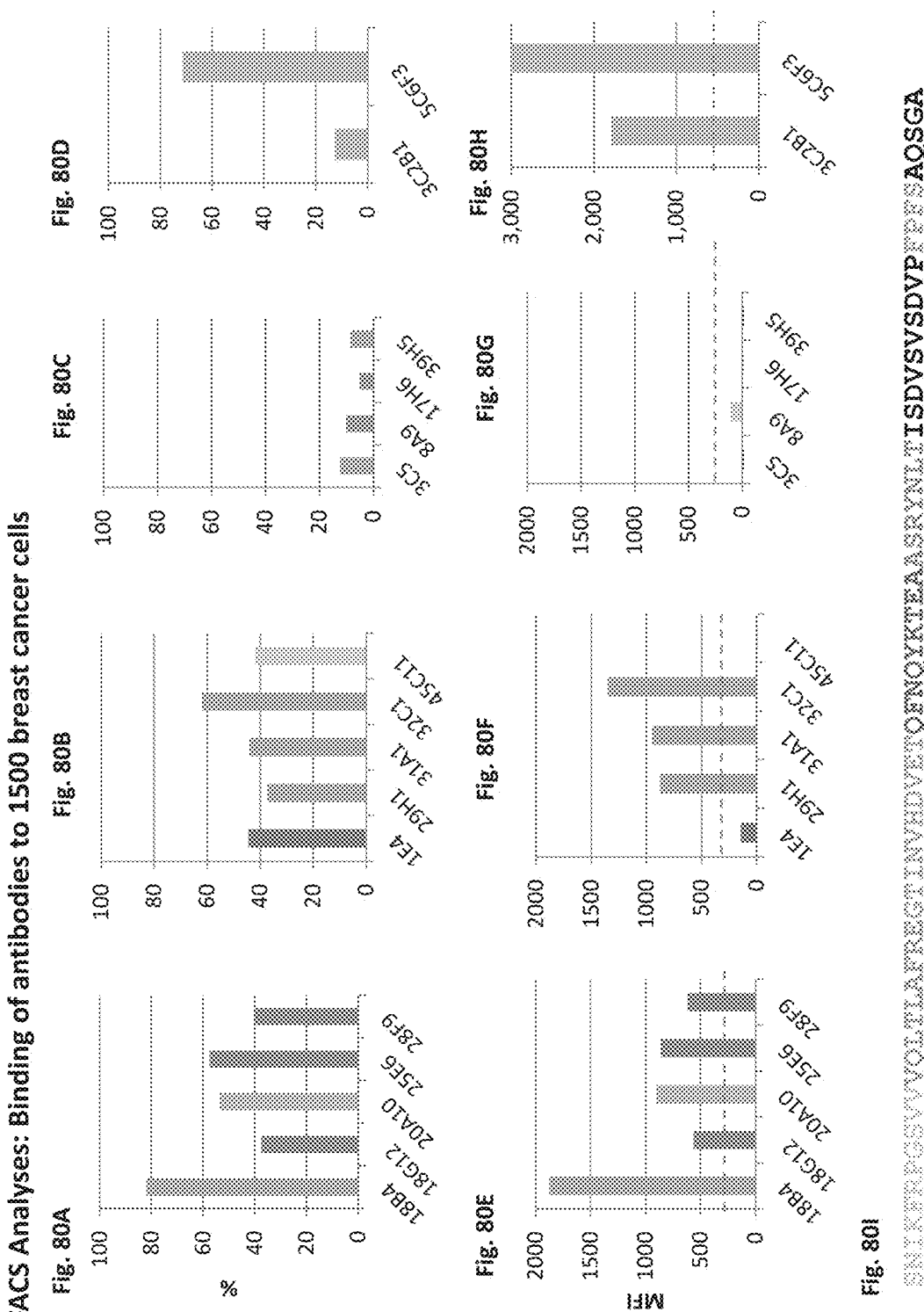
FACS Analyses: Binding of antibodies to 1500 breast cancer cells

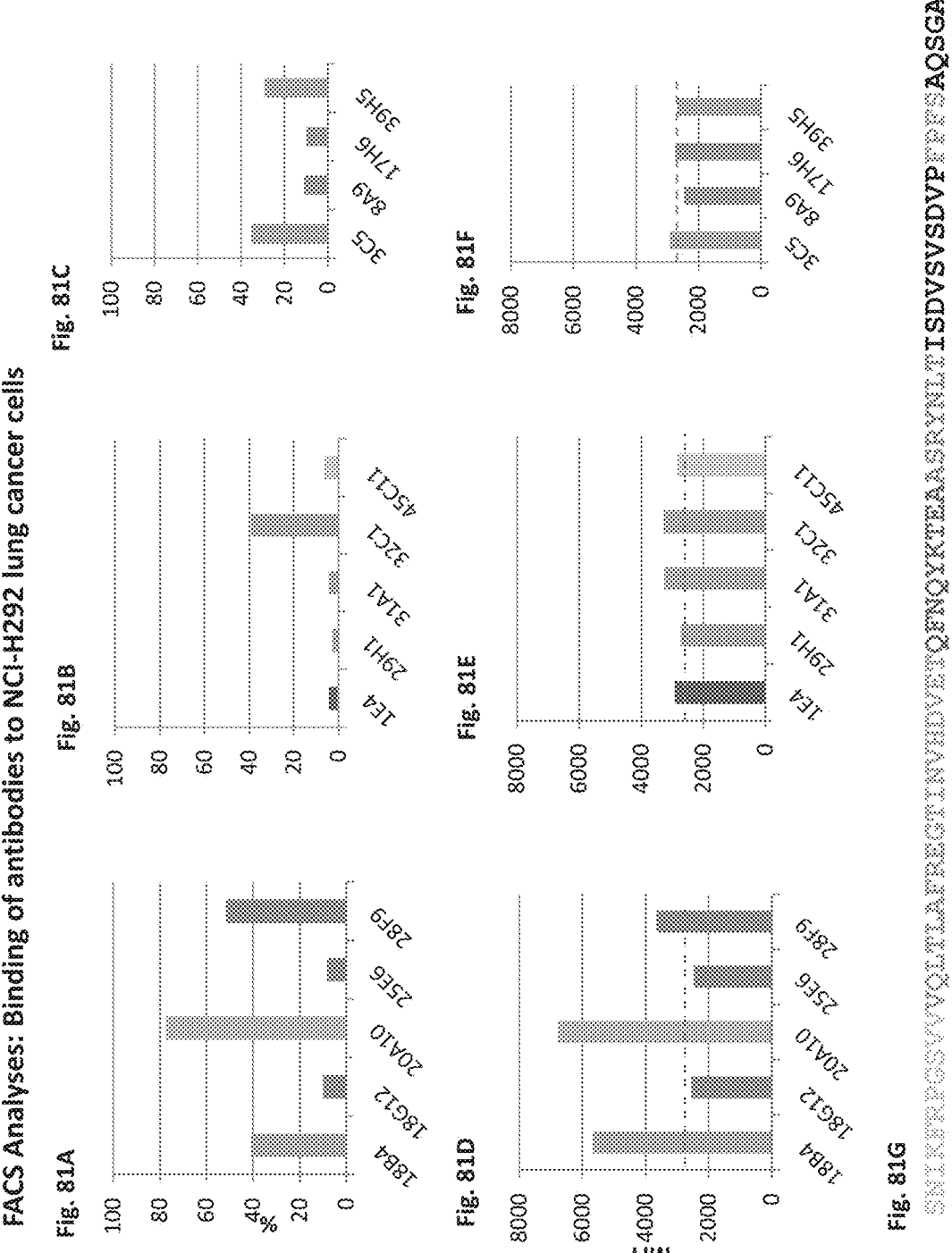
FACS Analyses: Binding of antibodies to NCI-H292 lung cancer cells

FACS Analyses: Binding of antibodies to NCI-H1975 lung cancer cells

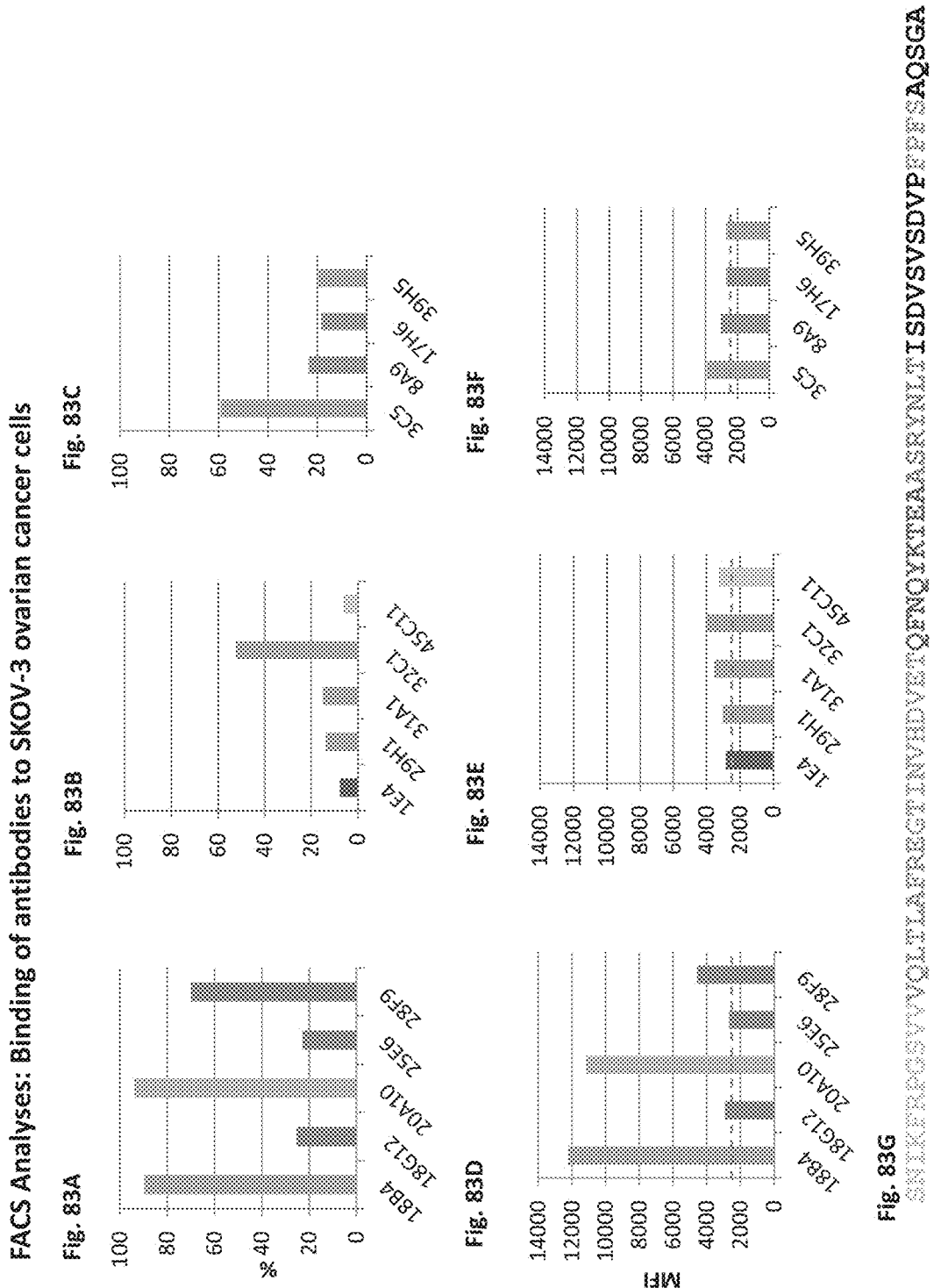
FACS Analyses: Binding of antibodies to SKOV-3 ovarian cancer cells

FACS Analyses: Binding of antibodies to DU145 prostate cancer cells

FACS Analyses: Binding of antibodies to HPAF-II pancreatic cancer cells

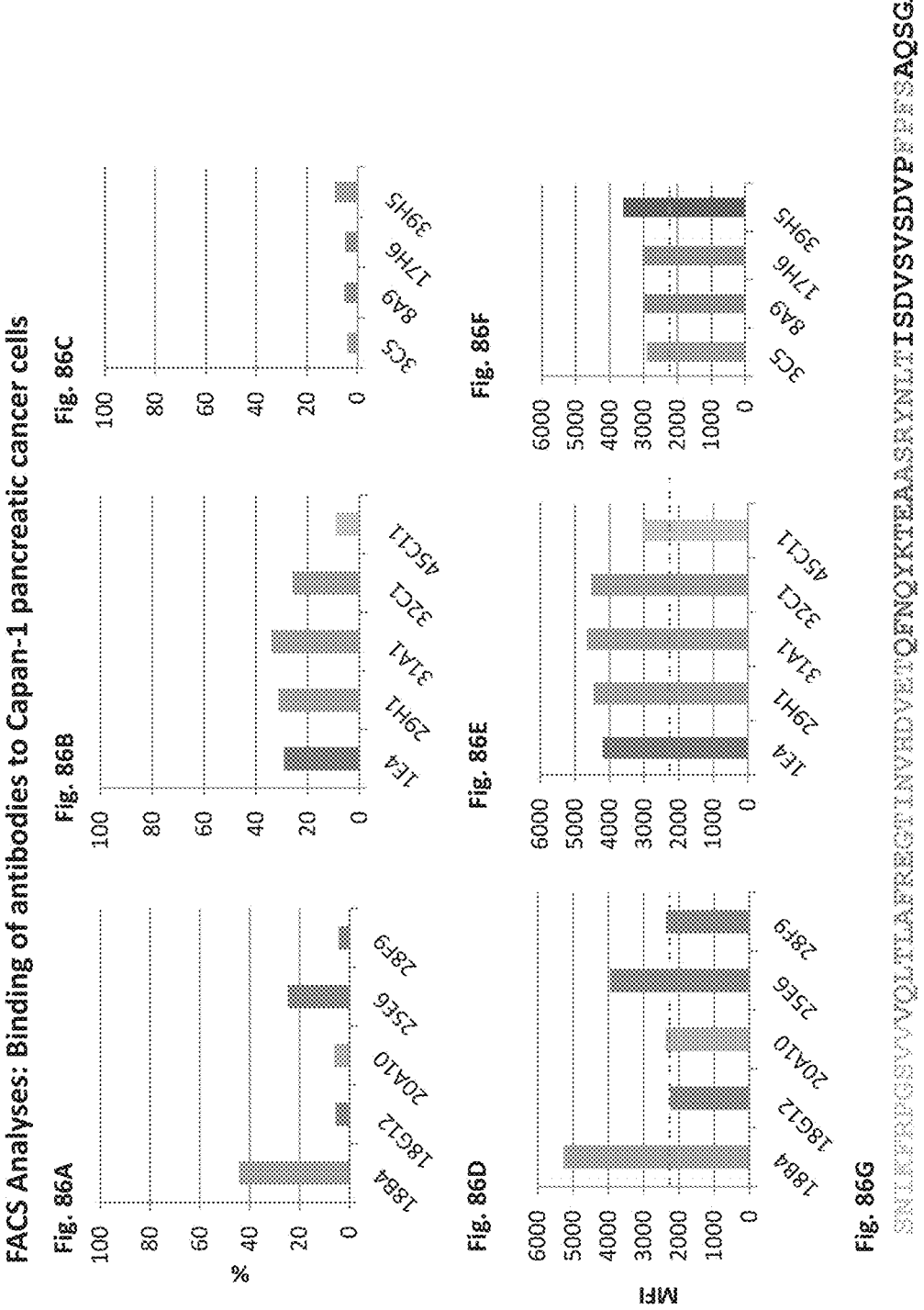
FACS Analyses: Binding of antibodies to Capan-1 pancreatic cancer cells

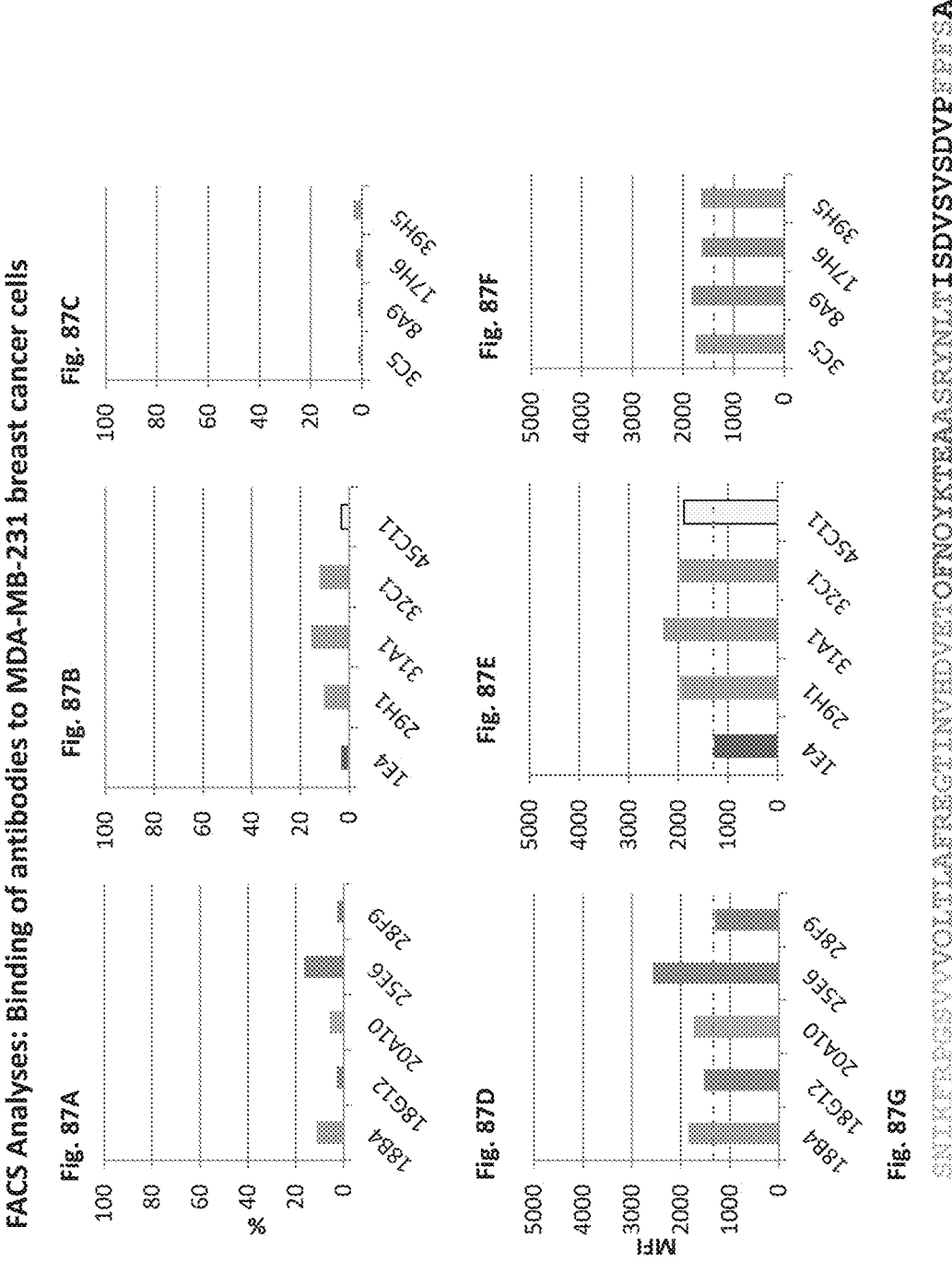
FACS Analyses: Binding of antibodies to MDA-MB-231 breast cancer cells

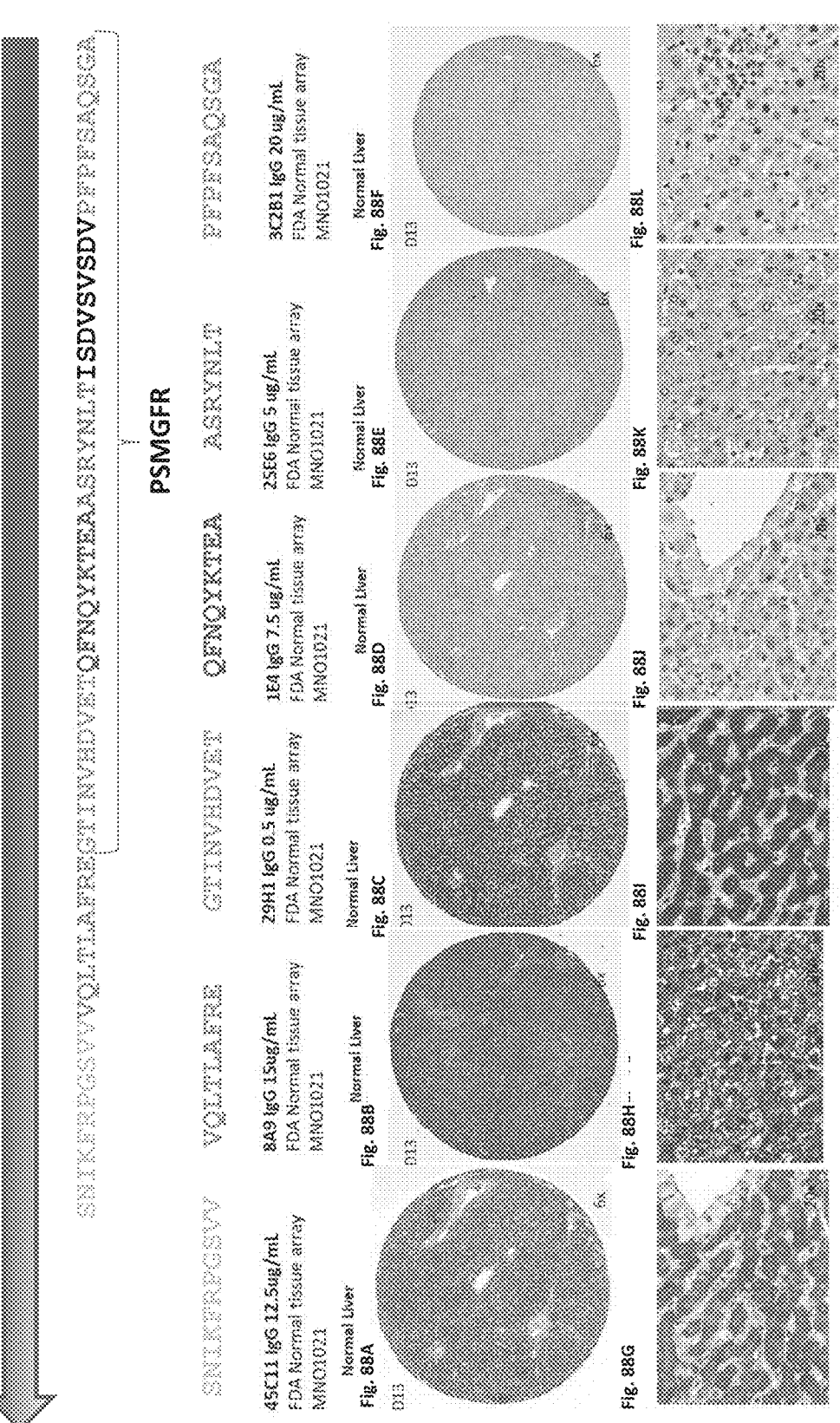

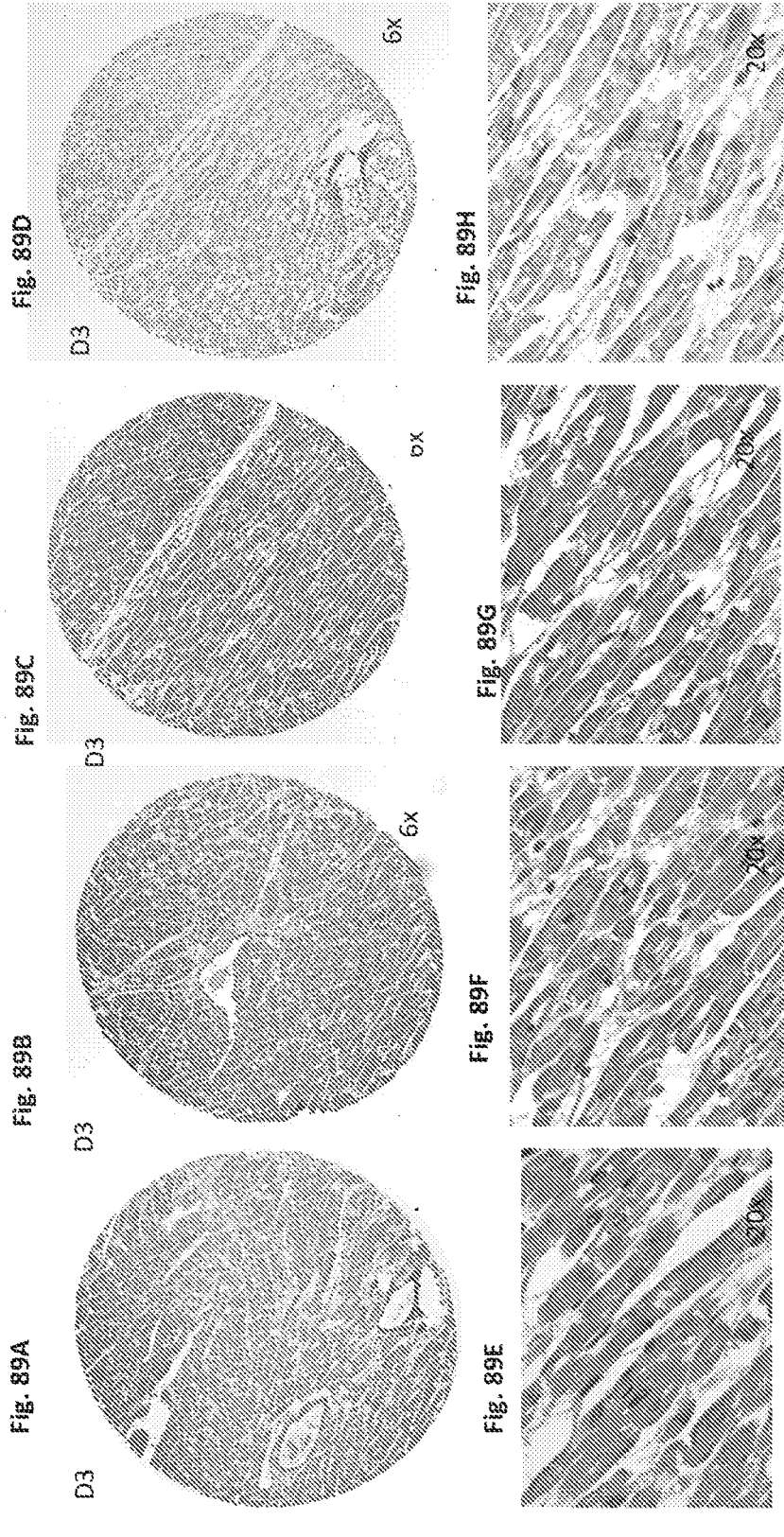

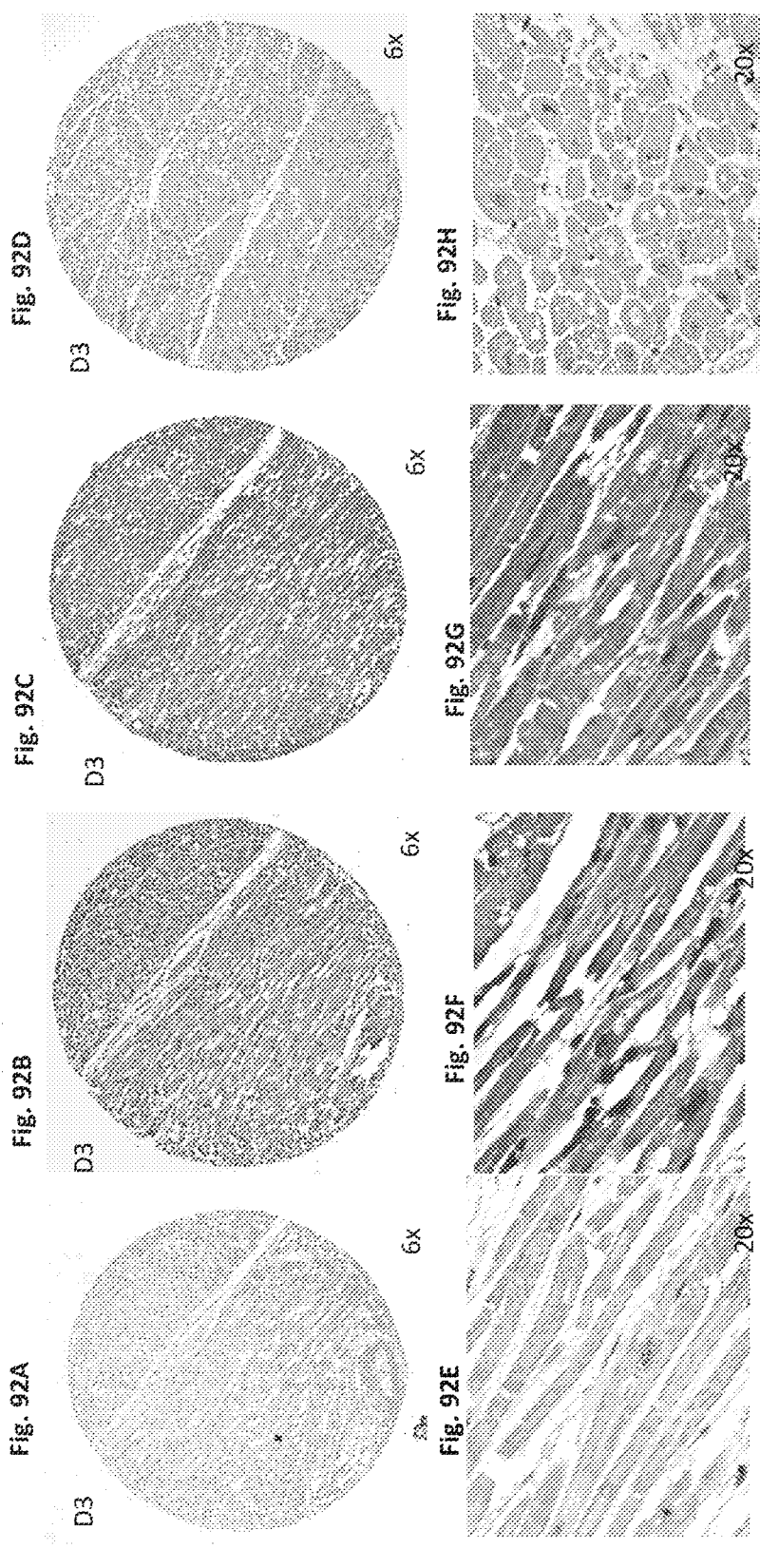

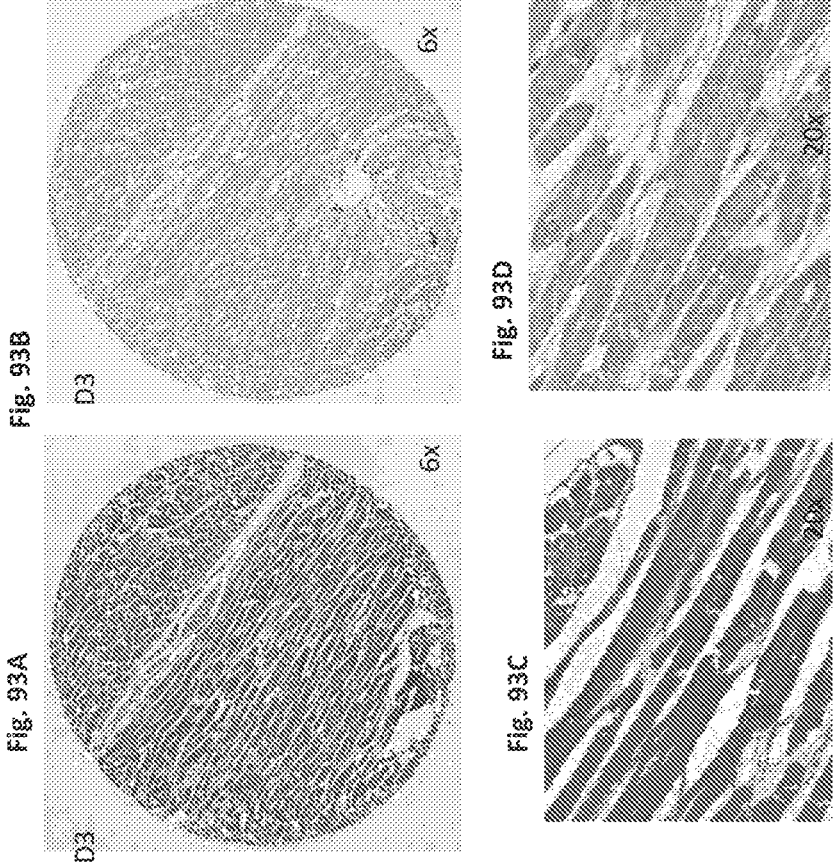

D3

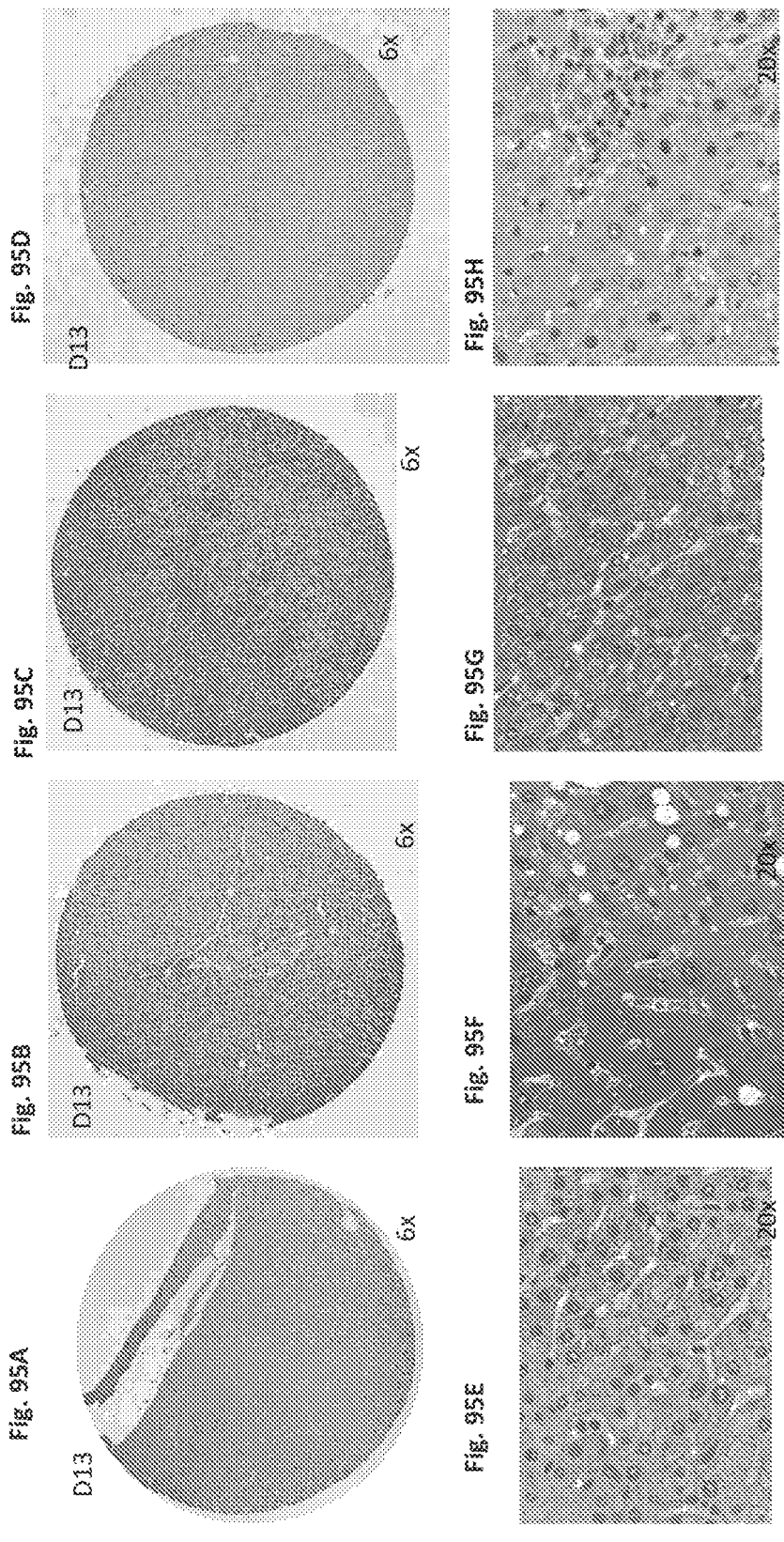

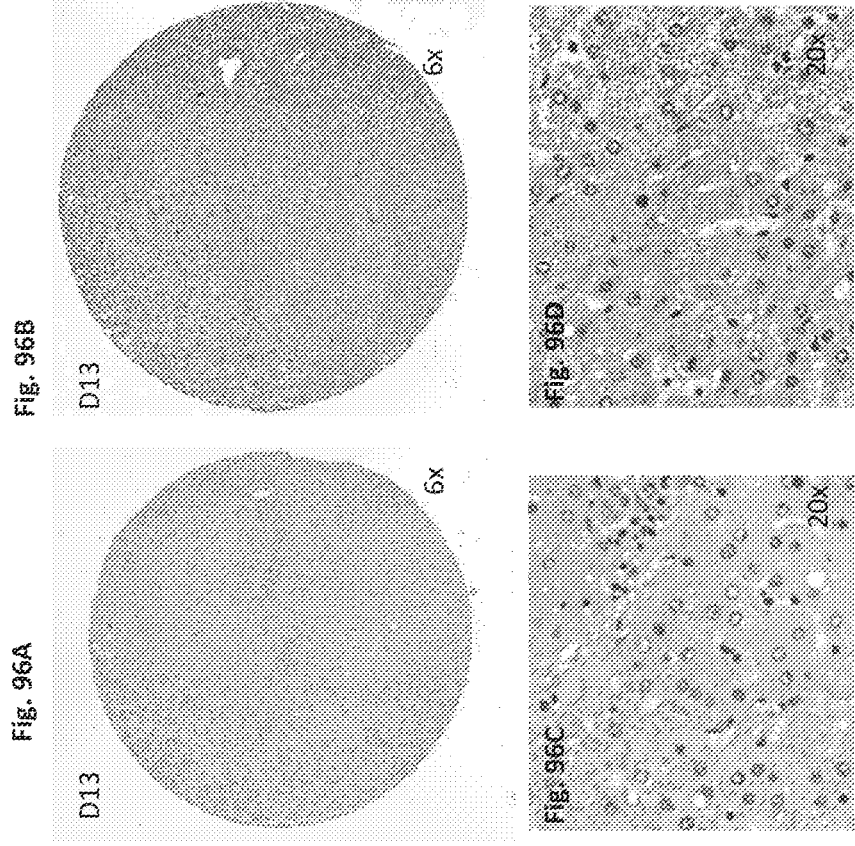

D13

6x

20x

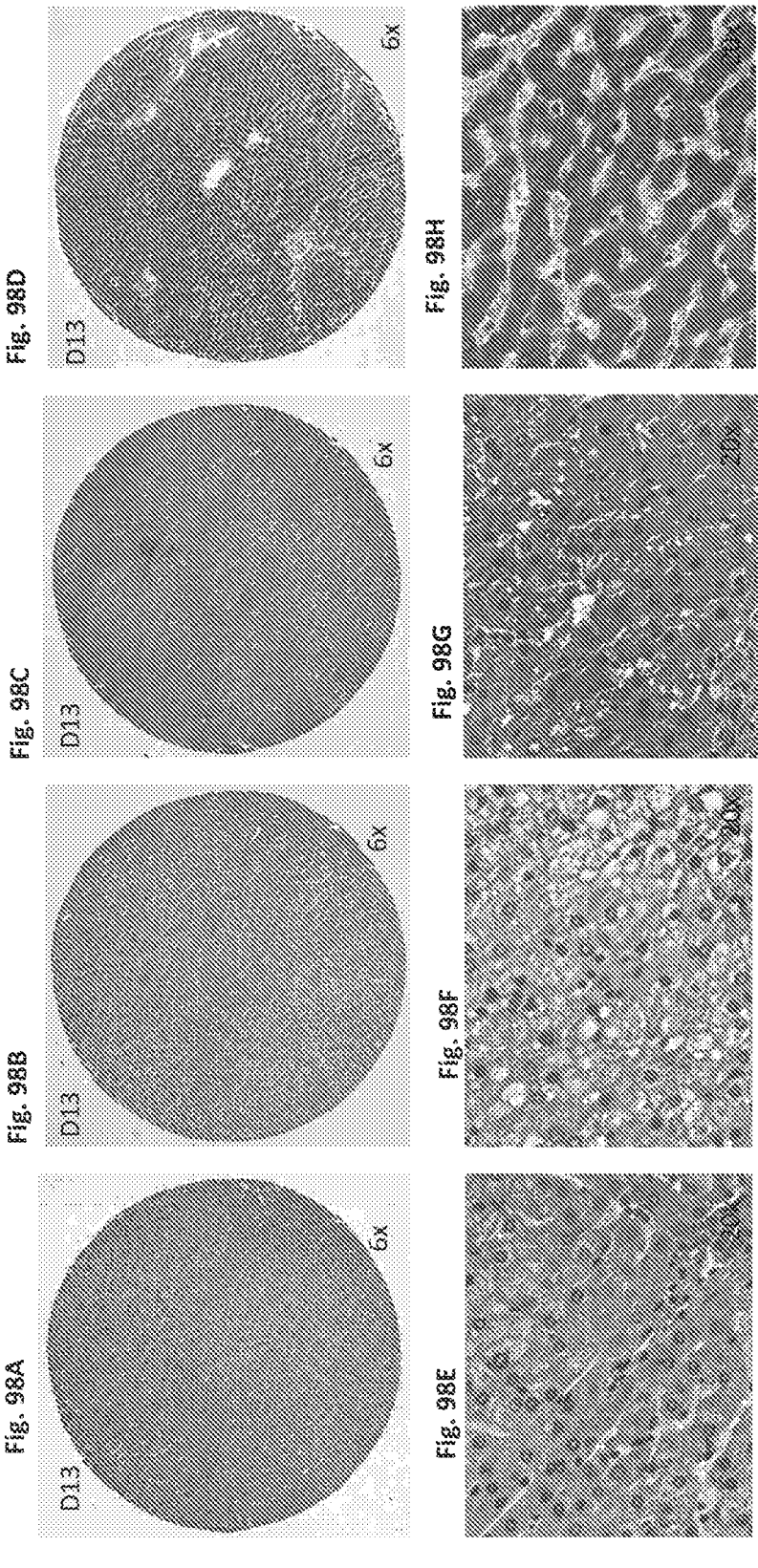

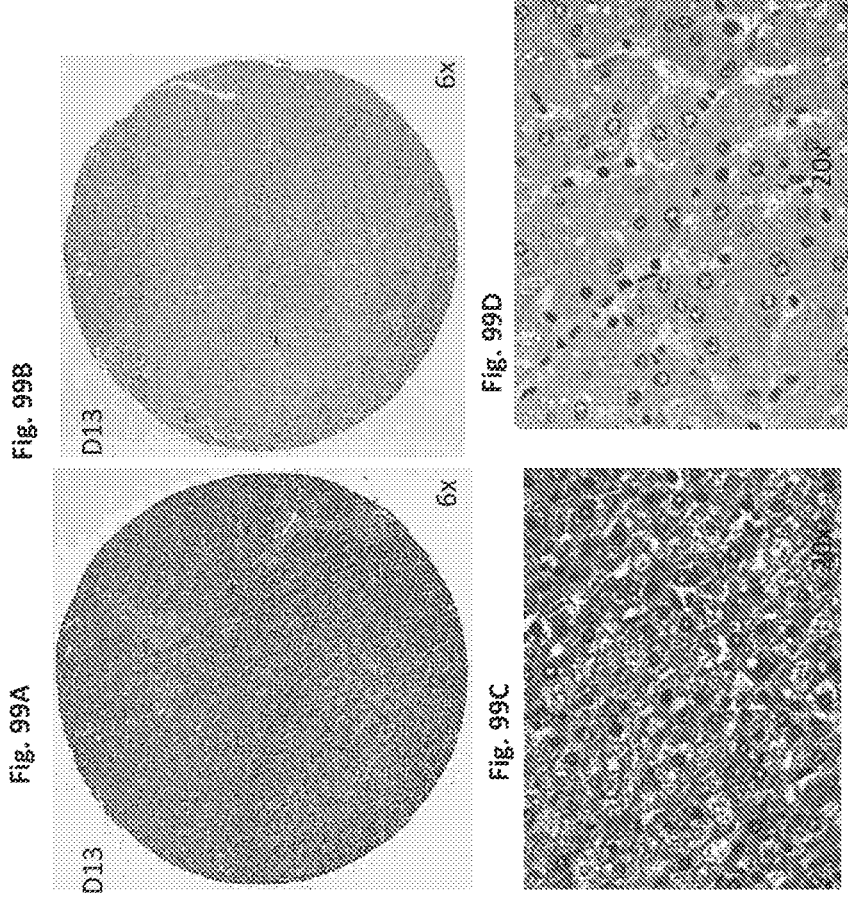

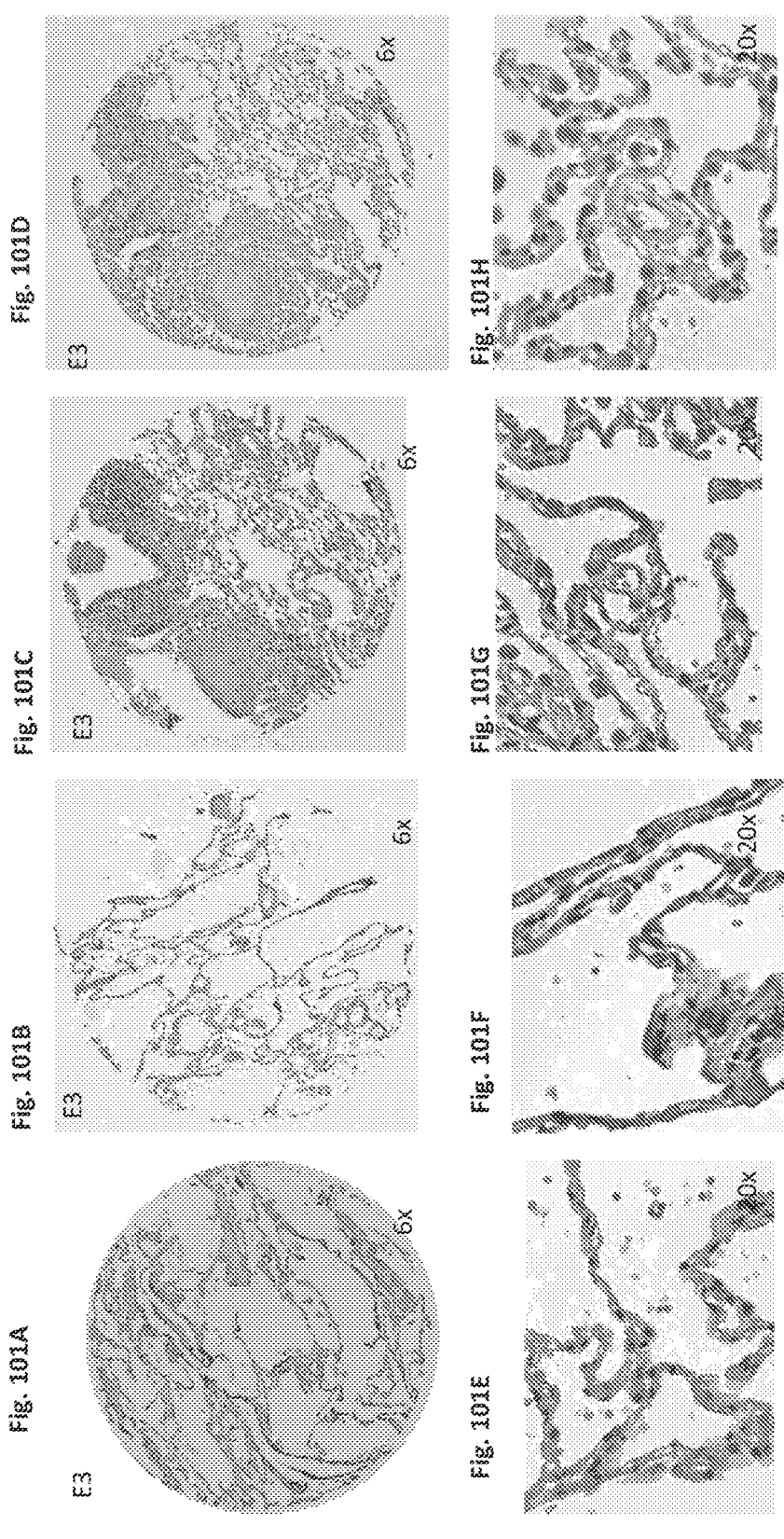

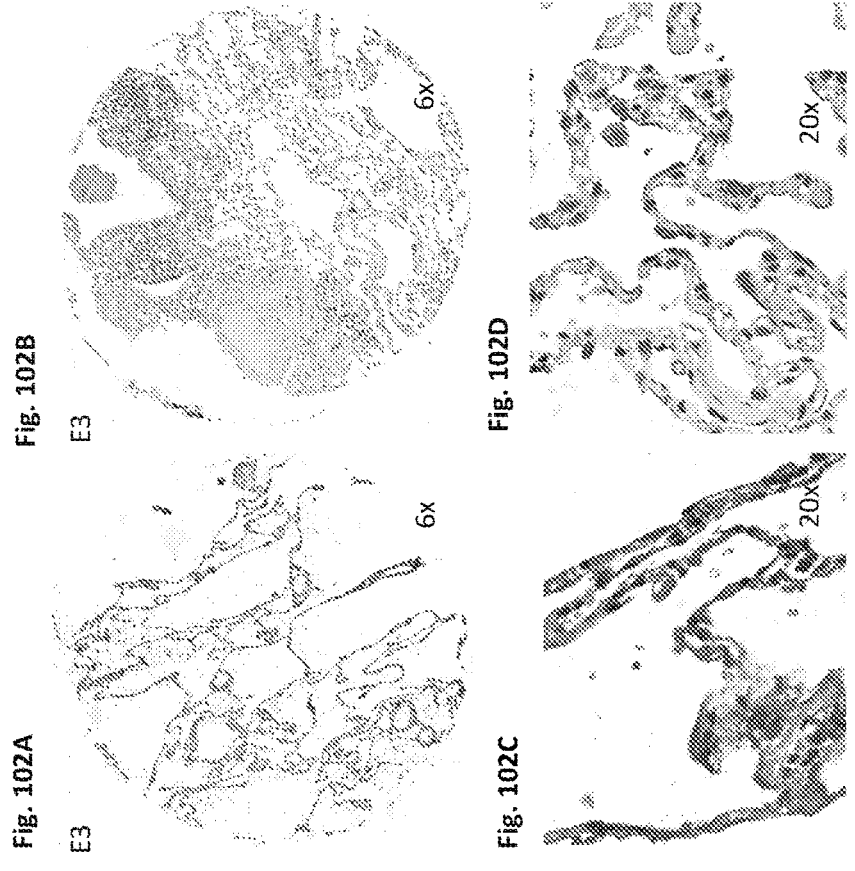
Fig. 102A    E3    6x
Fig. 102B    E3    6x
Fig. 102C    20X
Fig. 102D    20x Fig. 104A　E3
Fig. 104B　E3
Fig. 104C　E3
Fig. 104D　E3

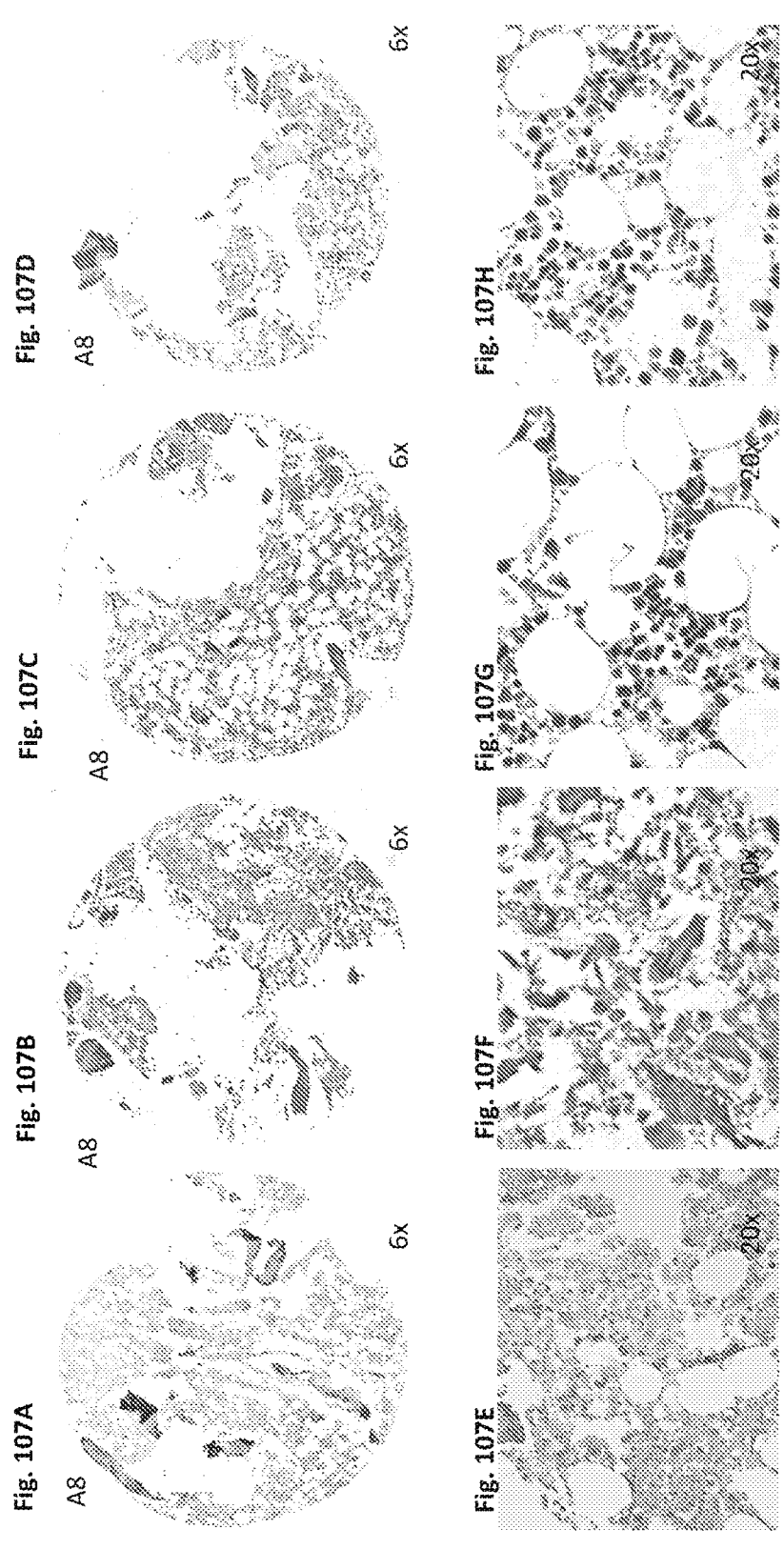

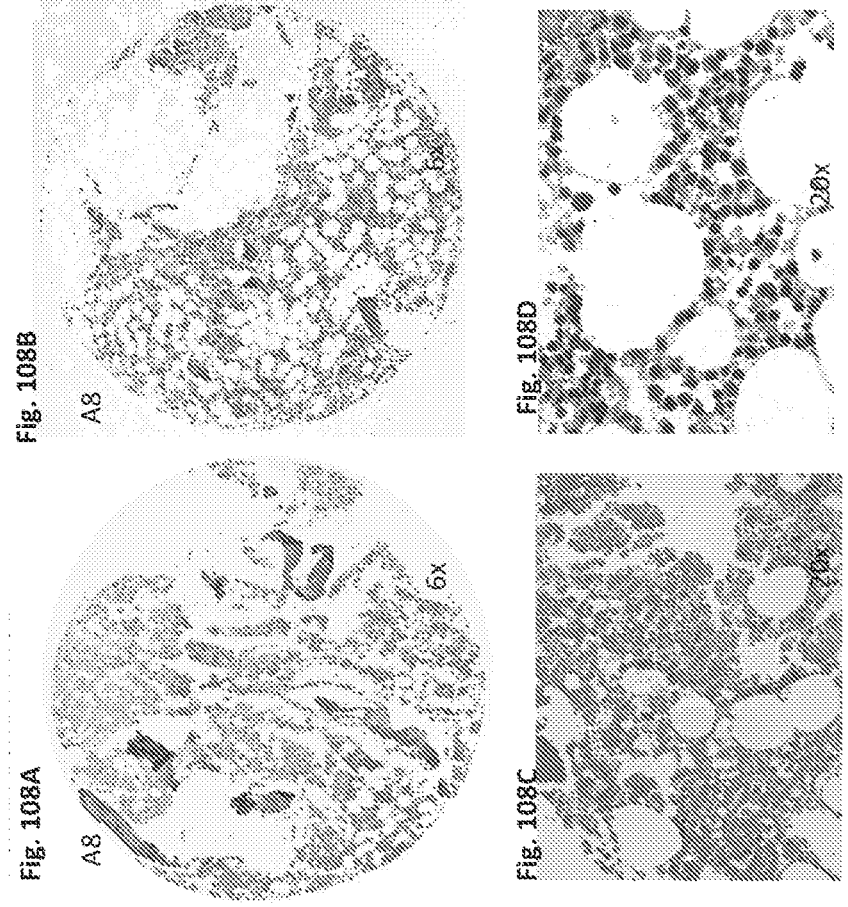

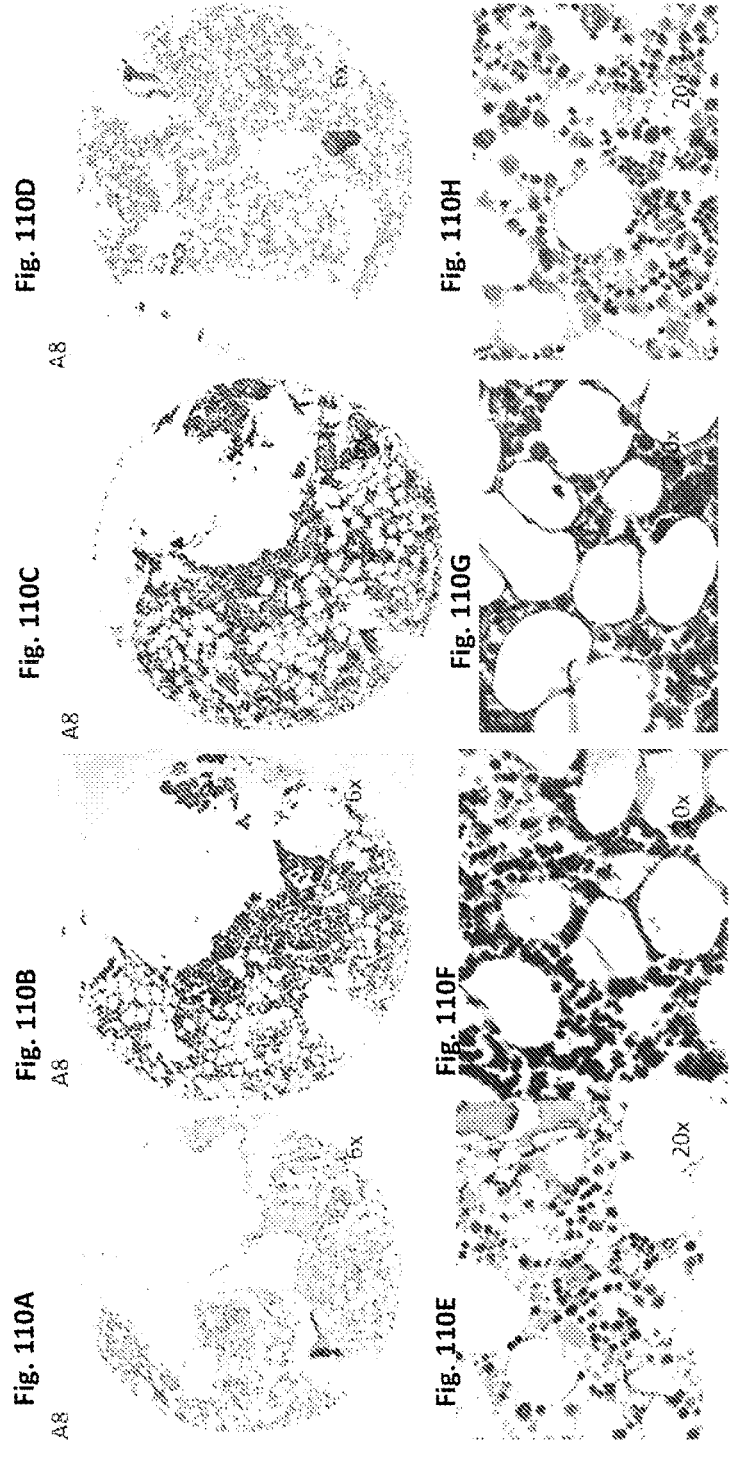

PSMGFR-antibody 20A10 IgG 0.25 ug/mL
FDA Normal tissue array MNO1021

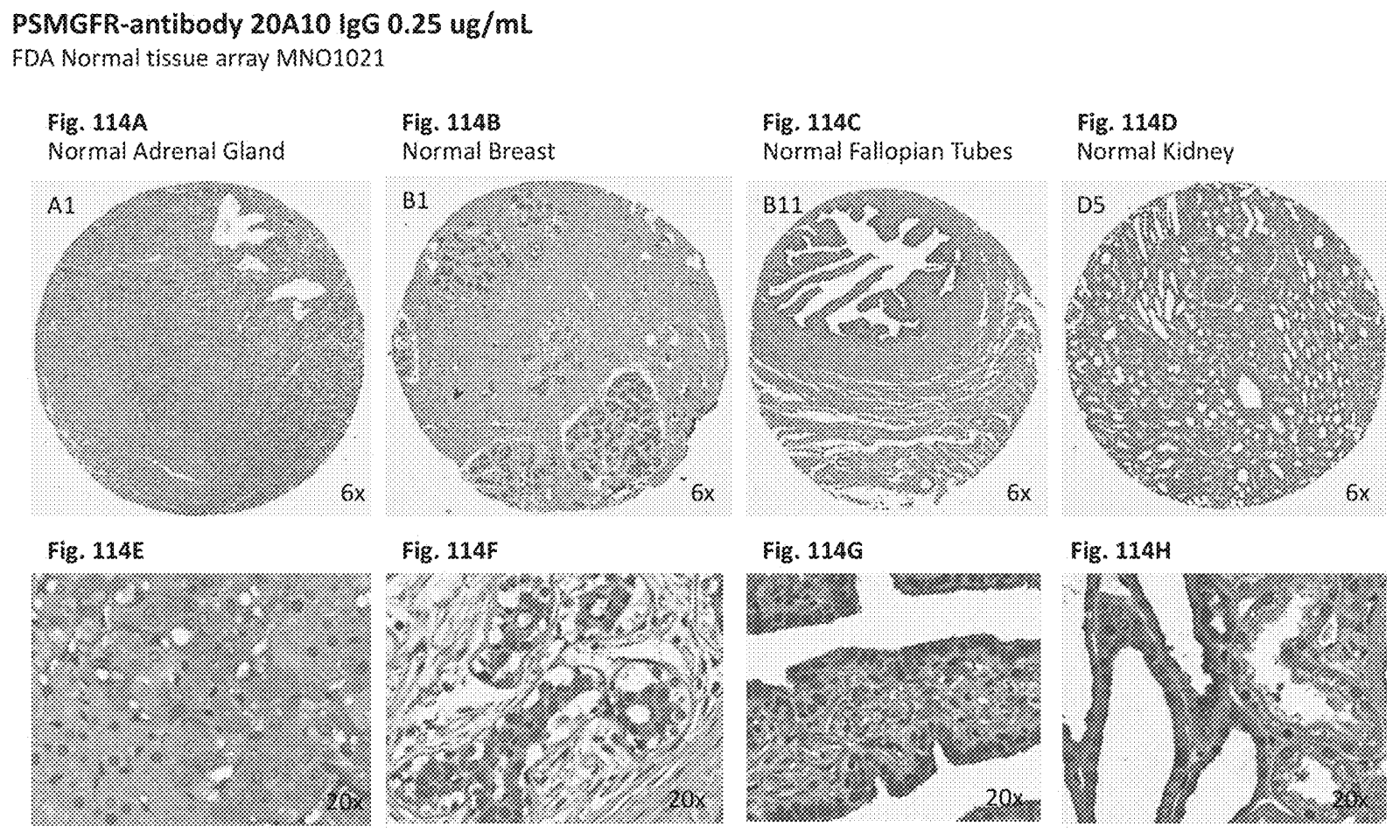

PSMGFR-antibody 20A10 IgG 0.25 ug/mL
FDA Normal tissue array MNO1021

Fig. 114A
Normal Adrenal Gland

Fig. 114B
Normal Breast

Fig. 114C
Normal Fallopian Tubes

Fig. 114D
Normal Kidney

PSMGFR-antibody 20A10 IgG 0.25 ug/mL
FDA Normal tissue array MNO1021

Normal Heart

Normal Liver

Normal Lung

Normal Ureter

PSMGFR-antibody 20A10 IgG 0.25 ug/mL
FDA Normal tissue array MNO1021

Normal Heart

Normal Liver

Normal Lung

Normal Ureter

PSMGFR-antibody 20A10 IgG 0.25 ug/mL
Breast cancer tissue array BR1141

PSMGFR-antibody 20A10 IgG 0.25 ug/mL
Breast cancer tissue array BR1141

Position: A4
Cell Type: Invasive Ductal Carcinoma
Tumor Grade: 2
TNM: T2N0M0

Position: A11
Cell Type: Invasive Ductal Carcinoma
Tumor Grade: 2
TNM: T2N0M0

Position: G11
Cell Type: Invasive Ductal Carcinoma
Tumor Grade: 2
TNM: T2N0M0

PSMGFR-antibody 20A10 IgG 0.25 ug/mL
Pancreatic cancer tissue array PA805c

PSMGFR-antibody 20A10 IgG 0.25 ug/mL
Pancreatic cancer tissue array PA805c

Fig. 118A    Position: D7
Cell Type: Papillary Adenocarcinoma
Tumor Grade: 2
TNM: T2N0M0

Fig. 118B    Position: E5
Cell Type: Ductal Carcinoma
Tumor Grade: 2-3
TNM: T3N1M0

Fig. 118C    Position: F1
Cell Type: Adenocarcinoma
Tumor Grade: 3
TNM: T3N0M0

PSMGFR-antibody 20A10 IgG 0.25 ug/mL
Esophageal cancer tissue array BC001113a

PSMGFR-antibody 20A10 IgG 0.25 ug/mL
Esophageal cancer tissue array BC001113a Fig. 120A       Position: A1
Cell Type: Adenocarcinoma
Tumor Grade: 2
TNM: T3N1M0

Fig. 120B       Position: A7
Cell Type: Adenocarcinoma
Tumor Grade: 3
TNM: T3N0M0

Fig. 120C       Position: A8
Cell Type: Adenocarcinoma
Tumor Grade: 3
TNM: T4N1M0

PSMGFR-antibody 3C2B1 20 ug/mL

FDA Normal tissue array MNO1021

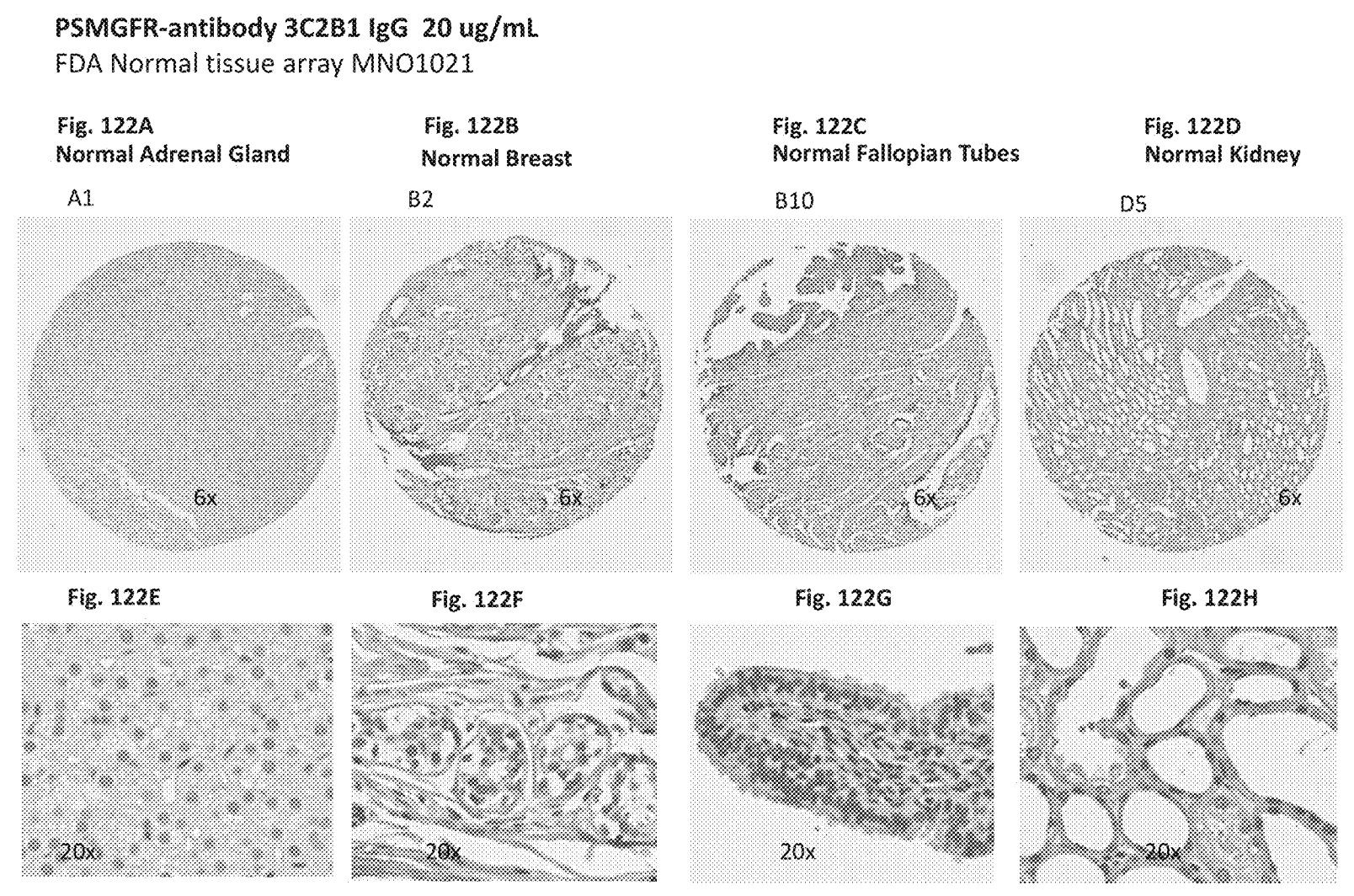

PSMGFR-antibody 3C2B1 IgG  20 ug/mL
FDA Normal tissue array MNO1021

Fig. 122A
Normal Adrenal Gland

Fig. 122B
Normal Breast

Fig. 122C
Normal Fallopian Tubes

Fig. 122D
Normal Kidney

PSMGFR-antibody 3C2B1 IgG 20 ug/mL
FDA Normal tissue array MNO1021

Fig. 122I
Normal Heart

Fig. 122J
Normal Liver

Fig. 122K
Normal Lung

Fig. 122L
Normal Ureter

PSMGFR-antibody 3C2B1 IgG 20 ug/mL
FDA Normal tissue array MNO1021

Normal eye

Normal Cerebral cortex

Normal Bone marrow

Normal Skeletal muscle

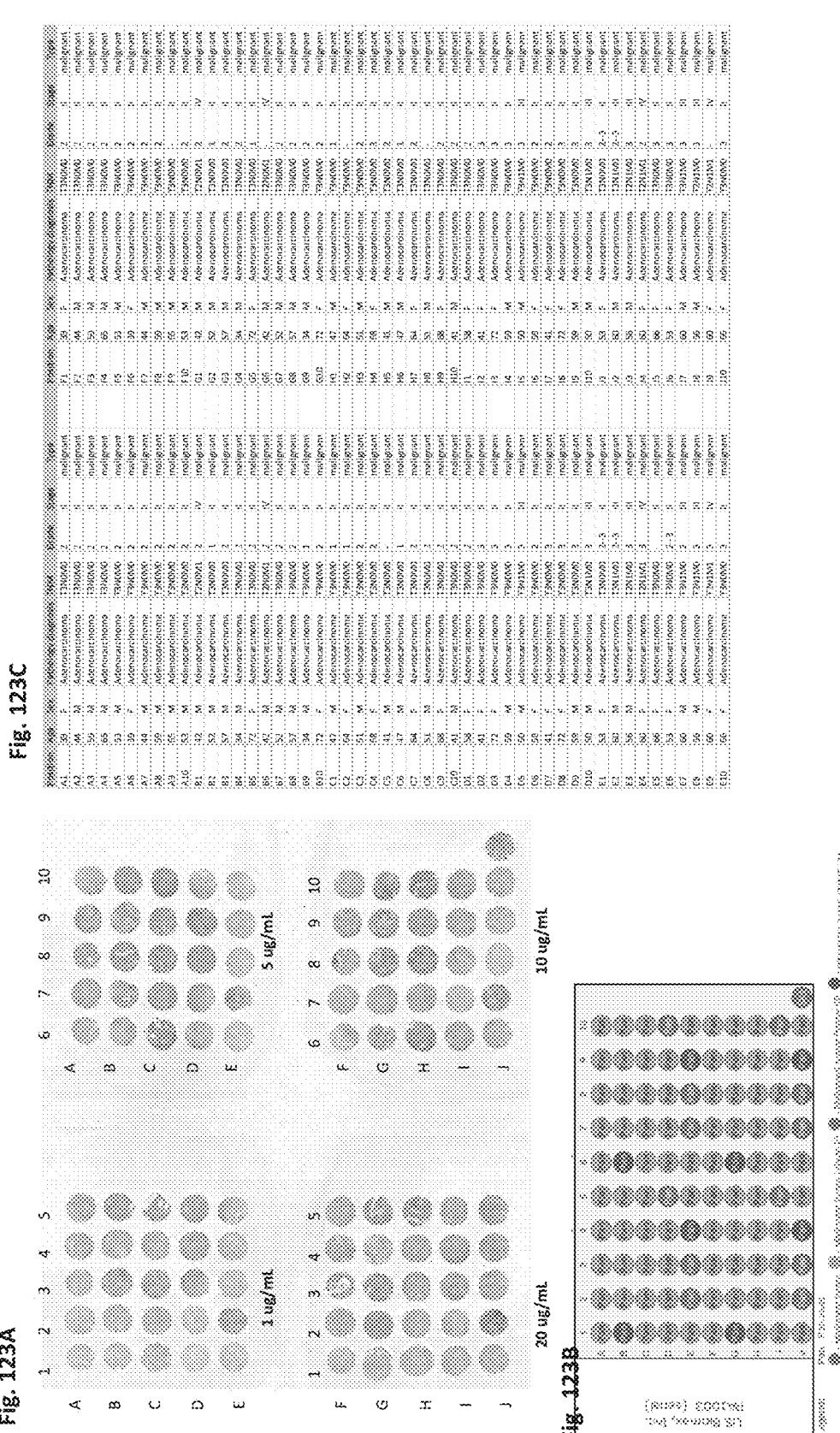

PSMGFR-antibody 3C2B1 IgG  20 ug/mL
Pancreatic cancer tissue array PA1003

Position: A2
Cell Type: Adenocarcinoma
Tumor Grade: 2
TNM: T3N0M0

Position: B2
Cell Type: Adenocarcinoma
Tumor Grade: 2
TNM: T3N0M0

Position: C2
Cell Type: Adenocarcinoma
Tumor Grade: 2
TNM: T3N0M0

PSMGFR-antibody 3C2B1 20 ug/mL
Breast cancer tissue array BR1141a

PSMGFR-antibody 3C2B1 20 ug/mL
Breast cancer tissue array BR1141a

Position: C6
Cell Type: Invasive carcinoma
Tumor Grade: 2
TNM: T3N2M0

Position: D6
Cell Type: Invasive carcinoma
Tumor Grade: 2
TNM: T2N0M0

Position: E1
Cell Type: Invasive carcinoma
Tumor Grade: 2
TNM: T2N0M0

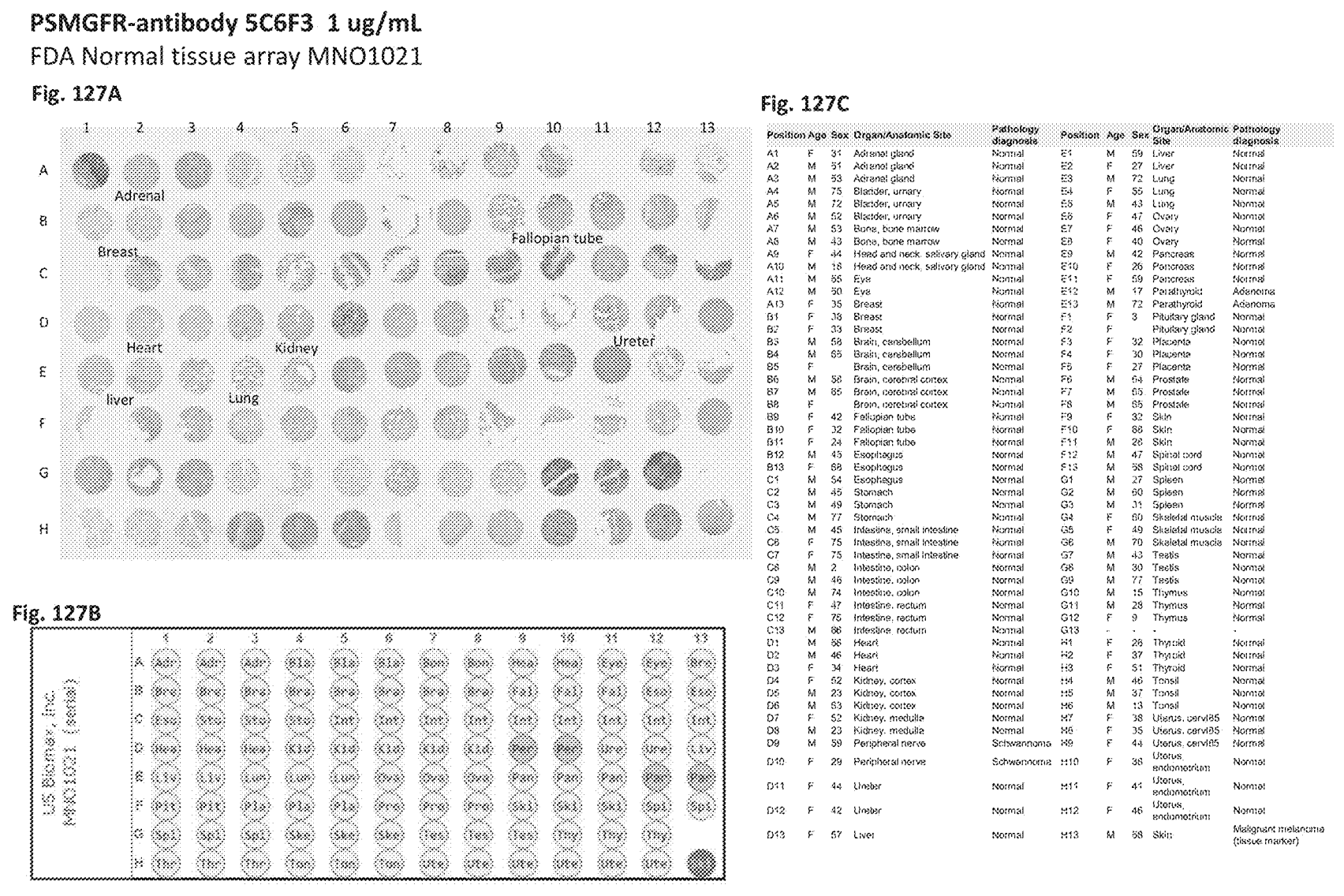

PSMGFR-antibody 5C6F3   1 ug/mL
FDA Normal tissue array MNO1021

Fig. 127A

Adrenal

Breast

Heart

Liver    Lung    Kidney    Fallopian tube    Ureter

Fig. 127B

US Biomax, Inc.    MNO1021 (serial)

Fig. 127C

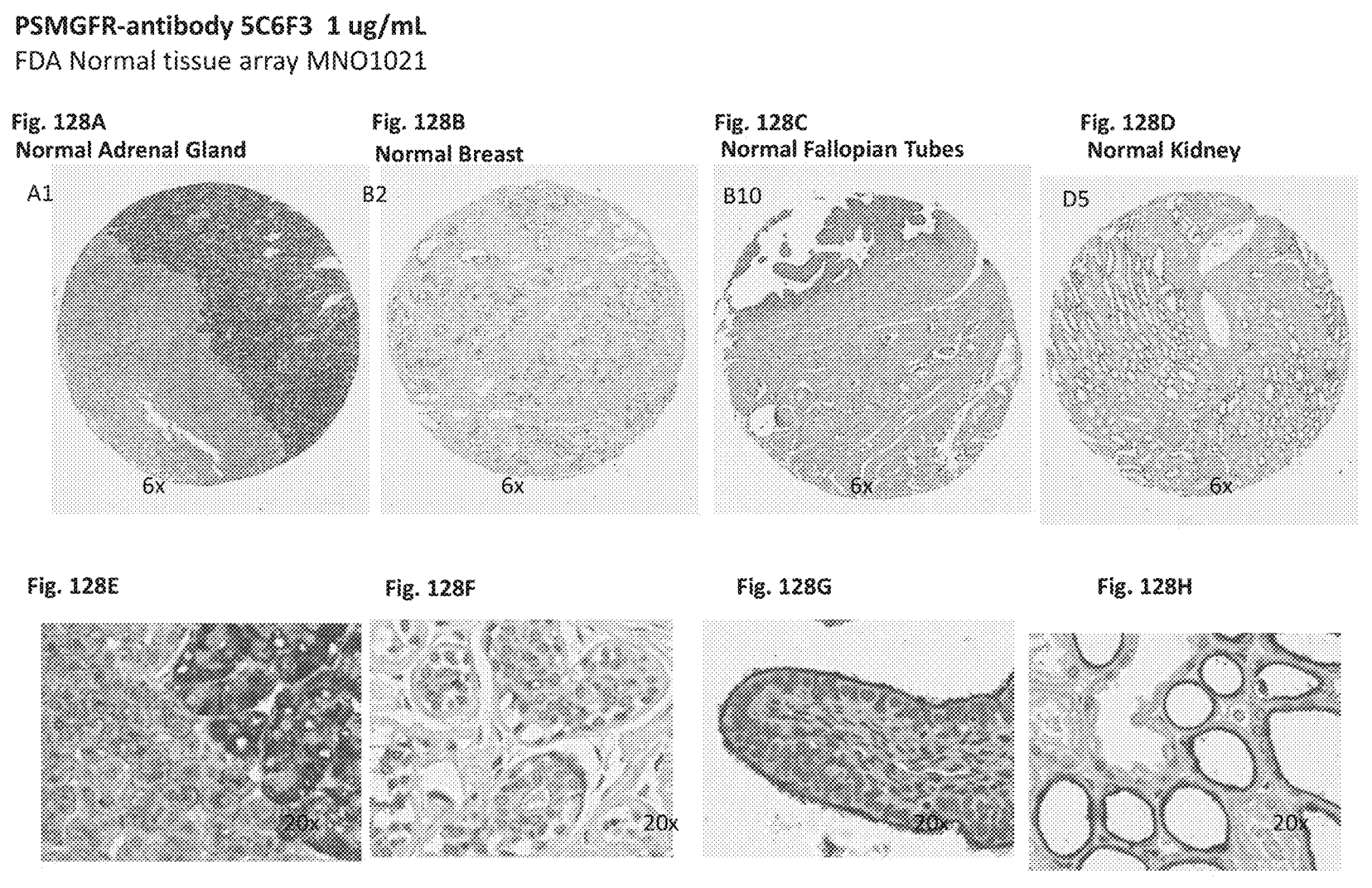

PSMGFR-antibody 5C6F3  1 ug/mL
FDA Normal tissue array MNO1021

Fig. 128A
Normal Adrenal Gland
A1
6x

Fig. 128B
Normal Breast
B2
6x

Fig. 128C
Normal Fallopian Tubes
B10
6x

Fig. 128D
Normal Kidney
D5
6x

PSMGFR-antibody 5C6F3  1 ug/mL
FDA Normal tissue array MNO1021

Fig. 128I
Normal Heart

Fig. 128J
Normal Liver

Fig. 128K
Normal Lung

Fig. 128L
Normal Ureter

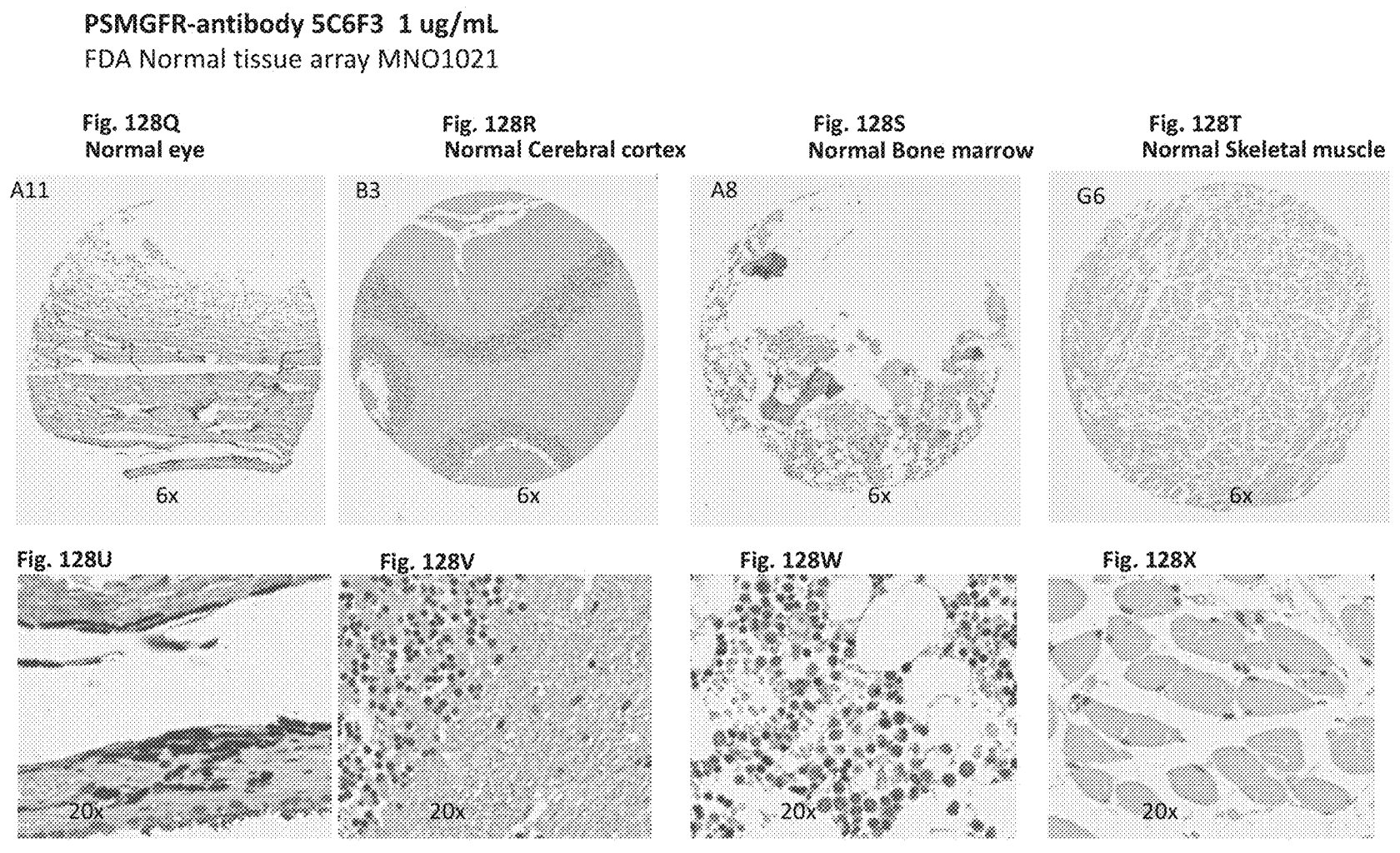

PSMGFR-antibody 5C6F3  1 ug/mL
FDA Normal tissue array MNO1021

Fig. 128Q
Normal eye

Fig. 128R
Normal Cerebral cortex

Fig. 128S
Normal Bone marrow

Fig. 128T
Normal Skeletal muscle

PSMGFR-antibody 5C6F3 1 - 20 ug/mL
Pancreatic cancer tissue array PA1003

PSMGFR-antibody 5C6F3　1 ug/mL
Pancreatic cancer tissue array PA1003

Position: A2
Cell Type: Adenocarcinoma
Tumor Grade: 2
TNM: T3N0M0

Position: B2
Cell Type: Adenocarcinoma
Tumor Grade: 2
TNM: T3N0M0

Position: C2
Cell Type: Adenocarcinoma
Tumor Grade: 2
TNM: T3N0M0

PSMGFR-antibody 5C6F3 1 ug/mL
Breast cancer tissue array BR1141a

PSMGFR-antibody 5C6F3 1 ug/mL
Breast cancer tissue array BR1141a

Position: B1
Cell Type: Invasive carcinoma
Tumor Grade: 2
TNM: T2N0M0

Position: B3
Cell Type: Invasive carcinoma
Tumor Grade: 2
TNM: T2N0M0

Position: B10
Cell Type: Invasive carcinoma
Tumor Grade: 2
TNM: T2N0M0

PSMGFR-antibody 18B4 IgG 10 ug/mL
FDA Normal tissue array MNO1021

| Position | Age | Sex | Organ/Anatomic Site | Pathology diagnosis | Position | Age | Sex | Organ/Anatomic Site | Pathology diagnosis |
|---|---|---|---|---|---|---|---|---|---|
| A1 | F | 31 | Adrenal gland | Normal | E1 | 59 | M | Liver | Normal |
| A2 | M | 51 | Adrenal gland | Normal | E2 | 27 | F | Liver | Normal |
| A3 | M | 53 | Adrenal gland | Normal | E3 | 72 | M | Lung | Normal |
| A4 | M | 75 | Bladder, urinary | Normal | E4 | 55 | M | Lung | Normal |
| A5 | M | 72 | Bladder, urinary | Normal | E5 | 43 | M | Lung | Normal |
| A6 | M | 52 | Bladder, urinary | Normal | E6 | 47 | F | Ovary | Normal |
| A7 | M | 53 | Bone, bone marrow | Normal | E7 | 46 | F | Ovary | Normal |
| A8 | M | 43 | Bone, bone marrow | Normal | E8 | 40 | F | Ovary | Normal |
| A9 | F | 44 | Head and neck, salivary gland | Normal | E9 | 42 | M | Pancreas | Normal |
| A10 | M | 18 | Head and neck, salivary gland | Normal | E10 | 26 | M | Pancreas | Normal |
| A11 | M | 55 | Eye | Normal | E11 | 59 | M | Pancreas | Normal |
| A12 | M | 50 | Eye | Absent na | E12 | 17 | M | Parathyroid | Absent na |
| A13 | F | 36 | Breast | Normal | E13 | 72 | M | Parathyroid | Normal |
| B1 | F | 38 | Breast | Normal | F1 | 3 | F | Pituitary gland | Normal |
| B2 | F | 33 | Breast | Normal | F2 | | F | Pituitary gland | Normal |
| B3 | M | 58 | Brain, cerebellum | Normal | F3 | | F | Placenta | Normal |
| B4 | M | 65 | Brain, cerebellum | Normal | F4 | 30 | F | Placenta | Normal |
| B5 | F | | Brain, cerebellum | Normal | F5 | 27 | F | Placenta | Normal |
| B6 | M | 58 | Brain, cerebral cortex | Normal | F6 | 64 | M | Prostate | Normal |
| B7 | M | 65 | Brain, cerebral cortex | Normal | F7 | 65 | M | Prostate | Normal |
| B8 | | | Brain, cerebral cortex | Normal | F8 | 65 | M | Prostate | Normal |
| B9 | F | 42 | Fallopian tube | Normal | F9 | 32 | F | Skin | Normal |
| B10 | F | 32 | Fallopian tube | Normal | F10 | 88 | M | Skin | Normal |
| B11 | F | 24 | Fallopian tube | Normal | F11 | 28 | M | Skin | Normal |
| B12 | M | 45 | Esophagus | Normal | F12 | 47 | M | Spinal cord | Normal |
| B13 | F | 88 | Esophagus | Normal | F13 | 58 | M | Spinal cord | Normal |
| C1 | F | 46 | Esophagus | Normal | G1 | 60 | M | Spleen | Normal |
| C2 | M | 49 | Stomach | Normal | G2 | 27 | M | Spleen | Normal |
| C3 | F | 77 | Stomach | Normal | G3 | 31 | M | Spleen | Normal |
| C4 | M | 45 | Intestine, small intestine | Normal | G4 | 60 | M | Skeletal muscle | Normal |
| C5 | M | 75 | Intestine, small intestine | Normal | G5 | 49 | F | Skeletal muscle | Normal |
| C6 | F | 75 | Intestine, small intestine | Normal | G6 | 70 | M | Skeletal muscle | Normal |
| C7 | F | 2 | Intestine, colon | Normal | G7 | 43 | M | Testis | Normal |
| C8 | M | 46 | Intestine, colon | Normal | G8 | 30 | M | Testis | Normal |
| C9 | M | 34 | Intestine, colon | Normal | G9 | 77 | M | Testis | Normal |
| C10 | M | 74 | Intestine, colon | Normal | G10 | 15 | M | Thymus | Normal |
| C11 | M | 47 | Intestine, rectum | Normal | G11 | 28 | M | Thymus | Normal |
| C12 | F | 75 | Intestine, rectum | Normal | G12 | 9 | F | Thymus | Normal |
| C13 | M | 66 | Intestine, rectum | Normal | G13 | | | | . |
| D1 | M | 46 | Heart | Normal | H1 | 26 | F | Thyroid | Normal |
| D2 | M | 58 | Heart | Normal | H2 | 37 | F | Thyroid | Normal |
| D3 | F | 34 | Heart | Normal | H3 | 51 | F | Thyroid | Normal |
| D4 | F | 52 | Kidney, cortex | Normal | H4 | 46 | M | Tonsil | Normal |
| D5 | M | 23 | Kidney, cortex | Normal | H5 | 37 | M | Tonsil | Normal |
| D6 | M | 63 | Kidney, cortex | Normal | H6 | 13 | M | Tonsil | Normal |
| D7 | F | 52 | Kidney, medulla | Normal | H7 | 38 | F | Uterus, cervix | Normal |
| D8 | M | 23 | Kidney, medulla | Normal | H8 | 35 | F | Uterus, cervix | Normal |
| D9 | F | 59 | Peripheral nerve | Schwannoma | H9 | 44 | F | Uterus, cervix | Normal |
| D10 | M | 29 | Peripheral nerve | Normal | H10 | 38 | F | Uterus, endometrium | Normal |
| D11 | F | 44 | Ureter | Normal | H11 | 41 | F | Uterus, endometrium | Normal |
| D12 | F | 42 | Ureter | Normal | H12 | 46 | F | Uterus, endometrium | Normal |
| D13 | F | 57 | Liver | Normal | H13 | 58 | M | Skin | Malignant melanoma (tissue marker) |

Figure 133A-133C

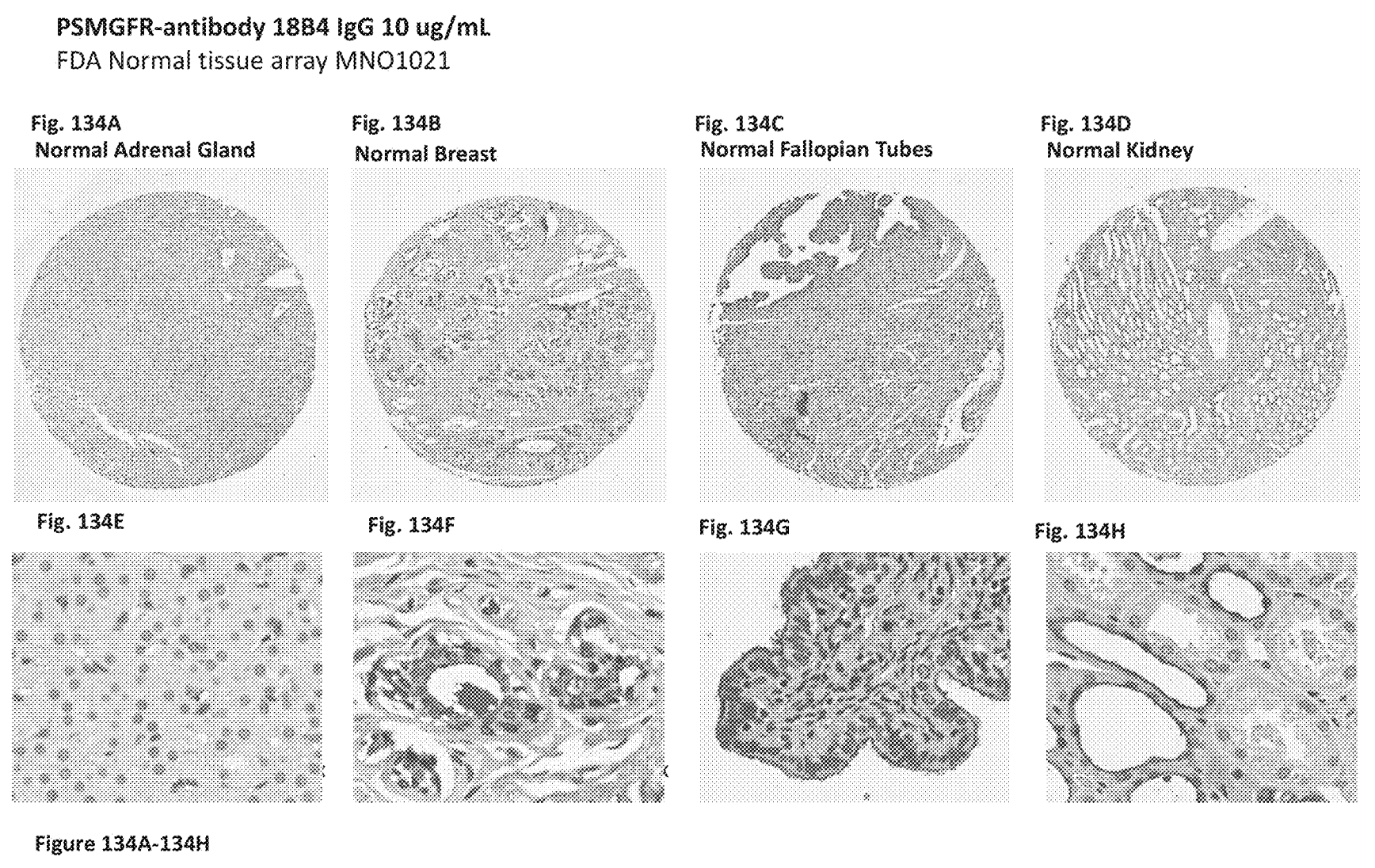

PSMGFR-antibody 18B4 IgG 10 ug/mL
FDA Normal tissue array MNO1021

Fig. 134A
Normal Adrenal Gland

Fig. 134B
Normal Breast

Fig. 134C
Normal Fallopian Tubes

Fig. 134D
Normal Kidney

PSMGFR-antibody 18B4 IgG 10 ug/mL
FDA Normal tissue array MNO1021

Normal Heart

Normal Liver

Normal Lung

Normal Ureter

PSMGFR-antibody 18B4 IgG 10 ug/mL
FDA Normal tissue array MNO1021

Normal Skeletal muscle

Normal Bone marrow

Normal Cerebral cortex

Normal eye

PSMGFR-antibody 18B4 10 ug/mL
Breast cancer tissue array BR1141

PSMGFR-antibody 18B4 10 ug/mL
Breast cancer tissue array BR1141

Position: A4
Cell Type: Invasive Ductal Carcinoma
Tumor Grade: 2
TNM: T2N0M0

Position: G9
Cell Type: Invasive Ductal Carcinoma
Tumor Grade: 2
TNM: T1N0M0

Position: G11
Cell Type: Invasive Ductal Carcinoma
Tumor Grade:
TNM: T2N1M0

PSMGFR antibody 18B4 IgG 10 ug/ml
Esophageal cancer tissue array BC001113

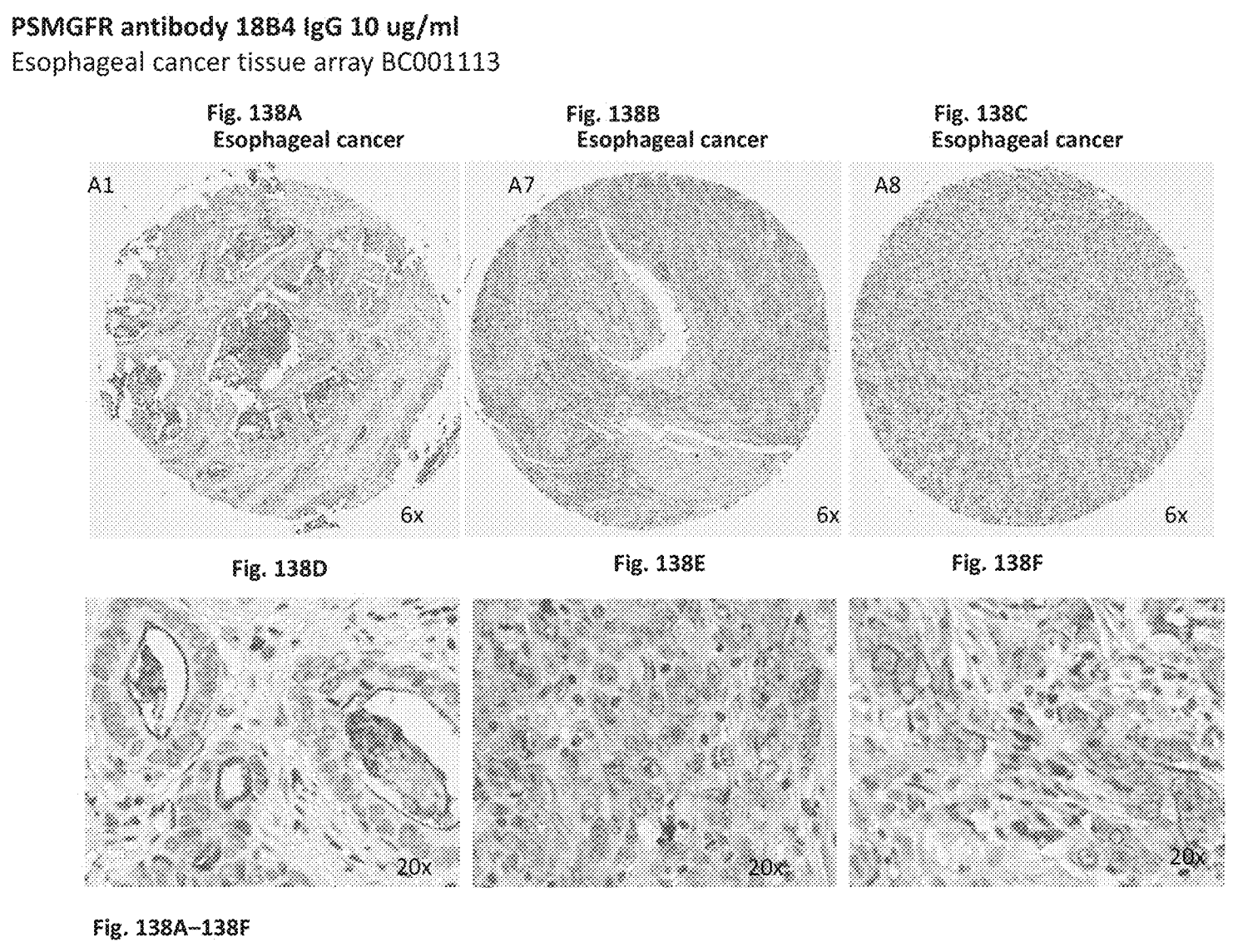

PSMGFR antibody 18B4 IgG 10 ug/ml
Esophageal cancer tissue array BC001113

Fig. 138A
Esophageal cancer

Fig. 138B
Esophageal cancer

Fig. 138C
Esophageal cancer

PSMGFR-antibody 18G12 IgG 10 ug/mL
FDA Normal tissue array MNO1021

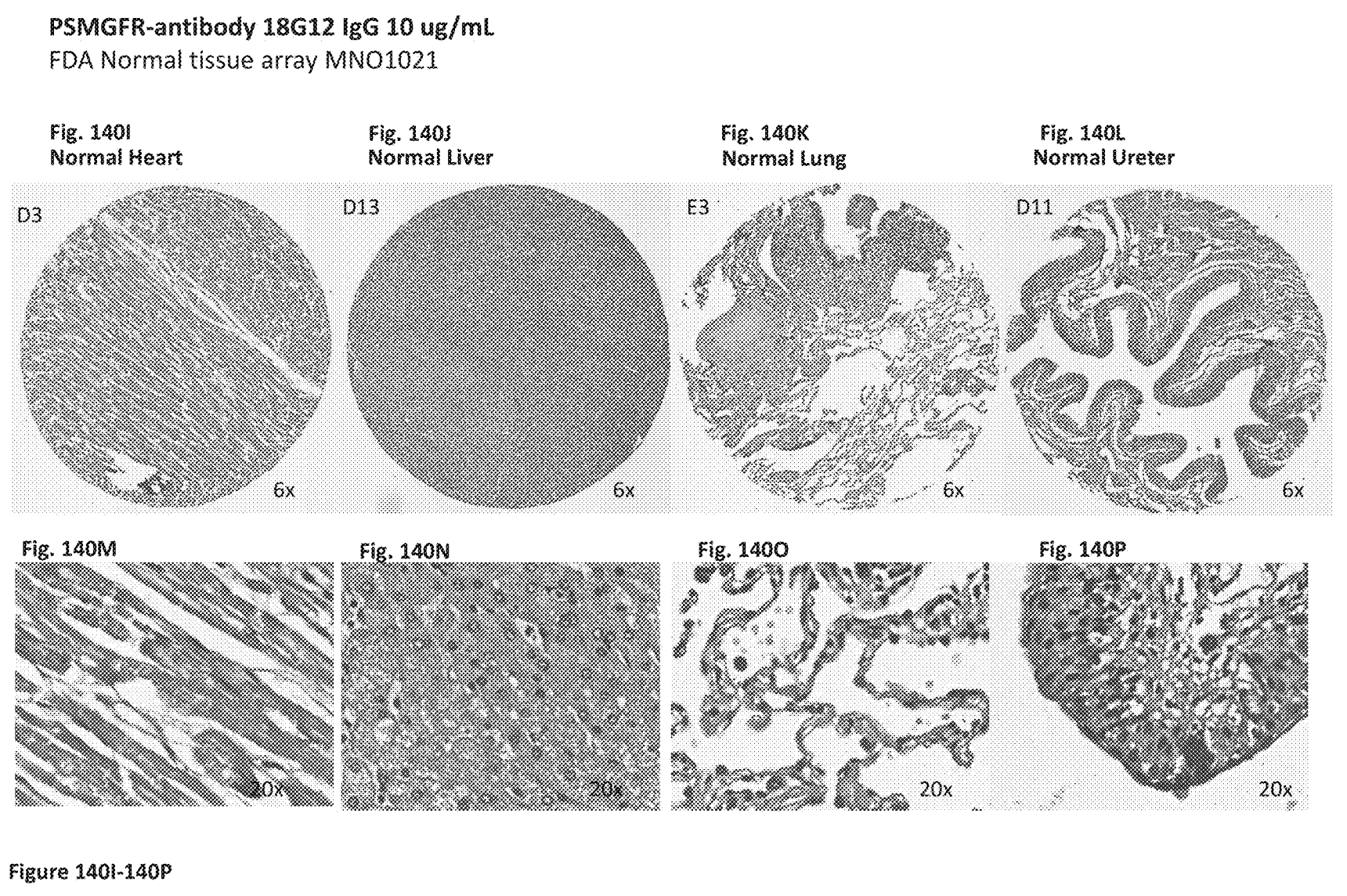

PSMGFR-antibody 18G12 IgG 10 ug/mL
FDA Normal tissue array MNO1021

Fig. 140I
Normal Heart

Fig. 140J
Normal Liver

Fig. 140K
Normal Lung

Fig. 140L
Normal Ureter

PSMGFR-antibody 18G12 IgG 10 ug/mL
FDA Normal tissue array MNO1021

Normal eye

Normal Cerebral cortex

Normal Bone marrow

Normal Skeletal muscle

PSMGFR-antibody 18G12  15 ug/mL
Breast cancer tissue array BR1141

PSMGFR-antibody 18G12 15 ug/mL
Breast cancer tissue array BR1141

Position: C5
Cell Type: Invasive Ductal Carcinoma
Tumor Grade: 2
TNM: T2N0M0

Position: G9
Cell Type: Invasive Ductal Carcinoma
Tumor Grade: 2
TNM: T1N0M0

Position: I1
Cell Type: Invasive Ductal Carcinoma
Tumor Grade:
TNM: T2N1M0

PSMGFR-antibody 18G12 1.0 – 15 ug/mL
Pancreatic cancer tissue array PA1003

PSMGFR-antibody 18G12 15 ug/mL
Pancreatic cancer tissue array PA1003

Position: A2
Cell Type: Adenocarcinoma
Tumor Grade: 2
TNM: T3N0M0

Position: B2
Cell Type: Adenocarcinoma
Tumor Grade: 1
TNM: T3N0M0

Position: C2
Cell Type: Adenocarcinoma
Tumor Grade: 1
TNM: T3N0M0

PSMGFR antibody 18G12 IgG 30 ug/ml
Esophageal cancer tissue array BC001113

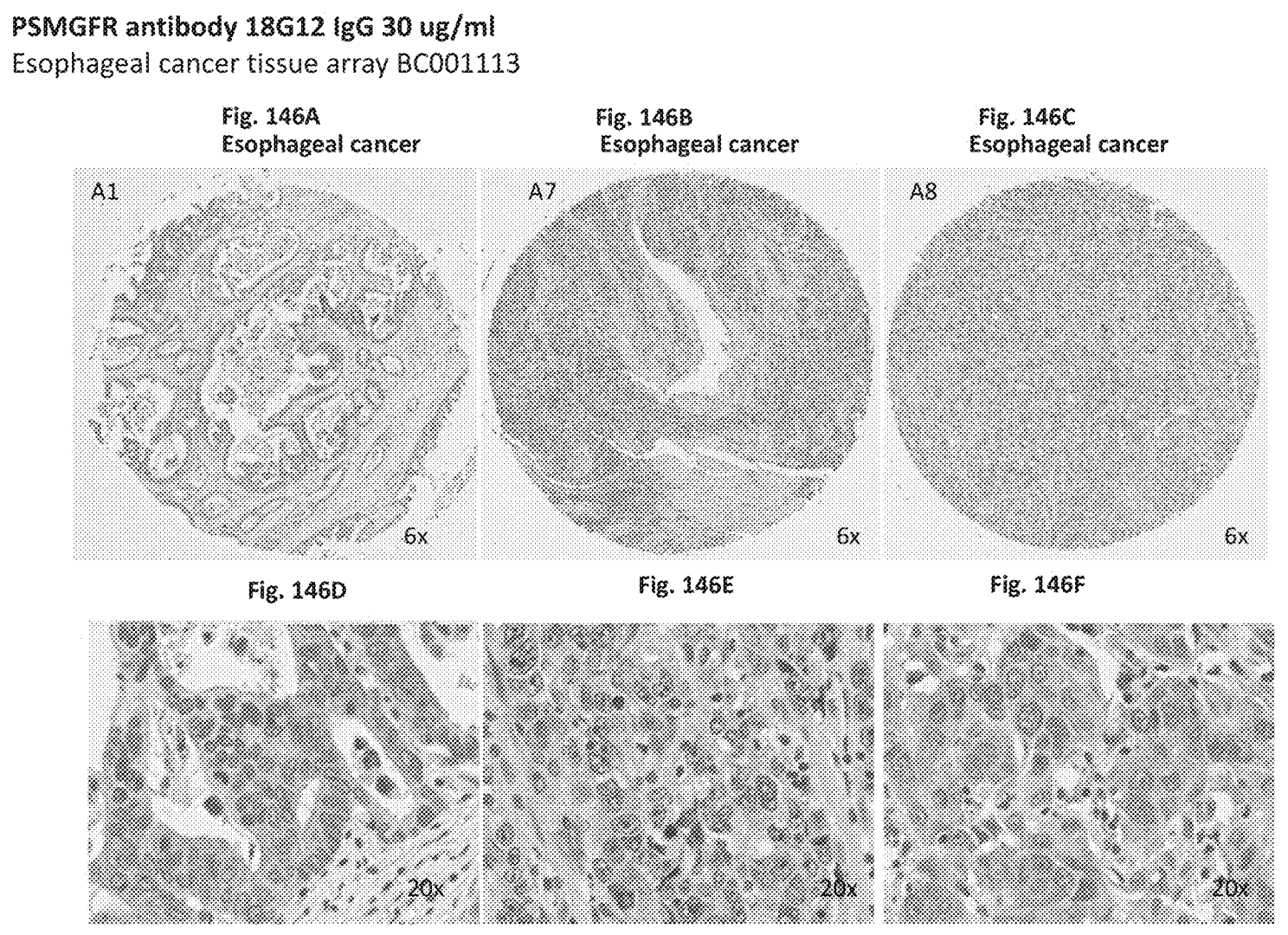

PSMGFR antibody 18G12 IgG 30 ug/ml
Esophageal cancer tissue array BC001113

Fig. 146A
Esophageal cancer

Fig. 146B
Esophageal cancer

Fig. 146C
Esophageal cancer

PSMGFR-antibody 25E6 IgG 5.0 ug/mL
FDA Normal tissue array MNO1021

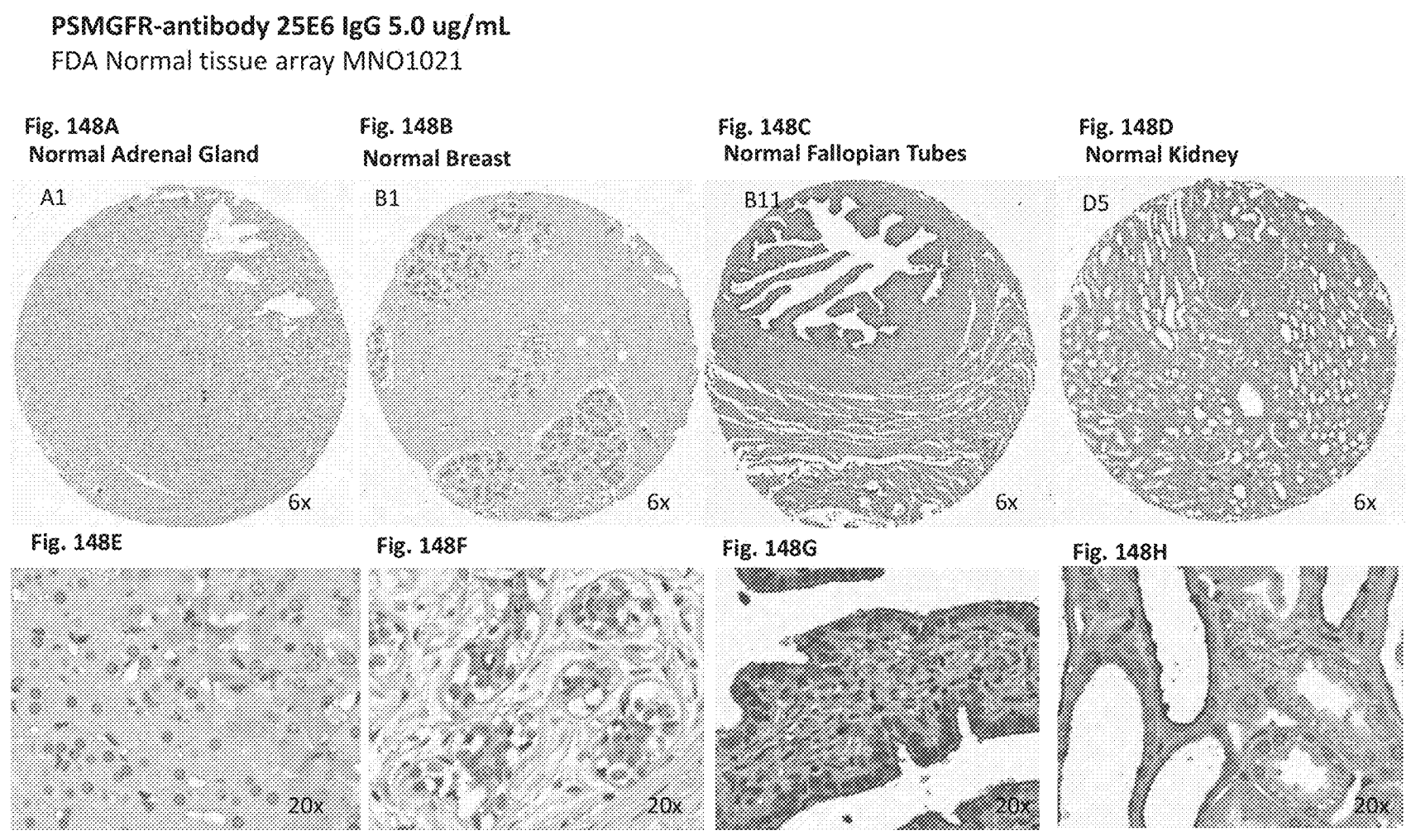

PSMGFR-antibody 25E6 IgG 5.0 ug/mL
FDA Normal tissue array MNO1021

Fig. 148A
Normal Adrenal Gland

Fig. 148B
Normal Breast

Fig. 148C
Normal Fallopian Tubes

Fig. 148D
Normal Kidney

PSMGFR-antibody 25E6 IgG 5.0 ug/mL
FDA Normal tissue array MNO1021

Fig. 148I
Normal Heart

Fig. 148J
Normal Liver

Fig. 148K
Normal Lung

Fig. 148L
Normal Ureter

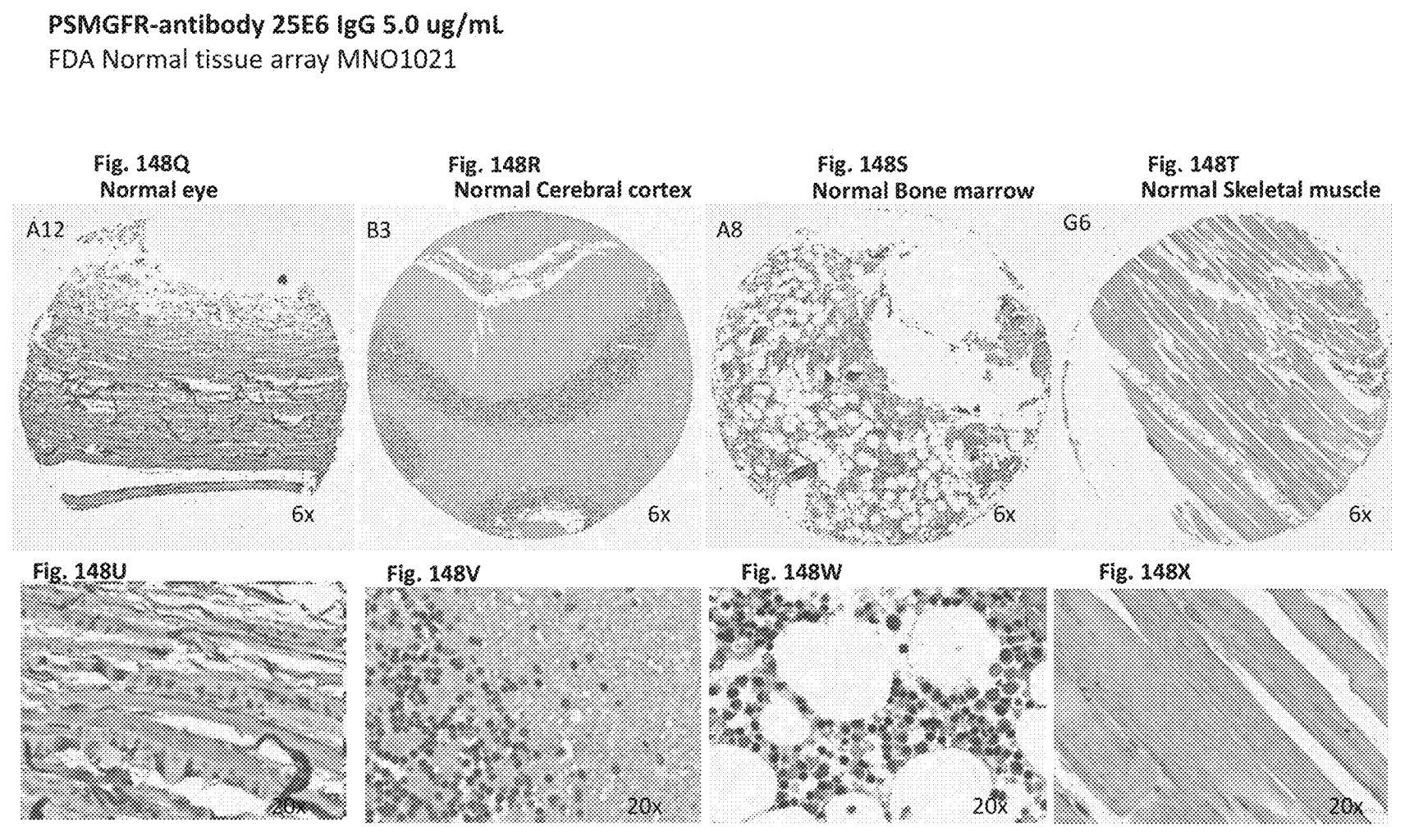

PSMGFR-antibody 25E6 IgG 5.0 ug/mL
FDA Normal tissue array MNO1021

Fig. 148Q
Normal eye

Fig. 148R
Normal Cerebral cortex

Fig. 148S
Normal Bone marrow

Fig. 148T
Normal Skeletal muscle

PSMGFR-antibody 25E6  5 ug/mL
Breast cancer tissue array BR1141

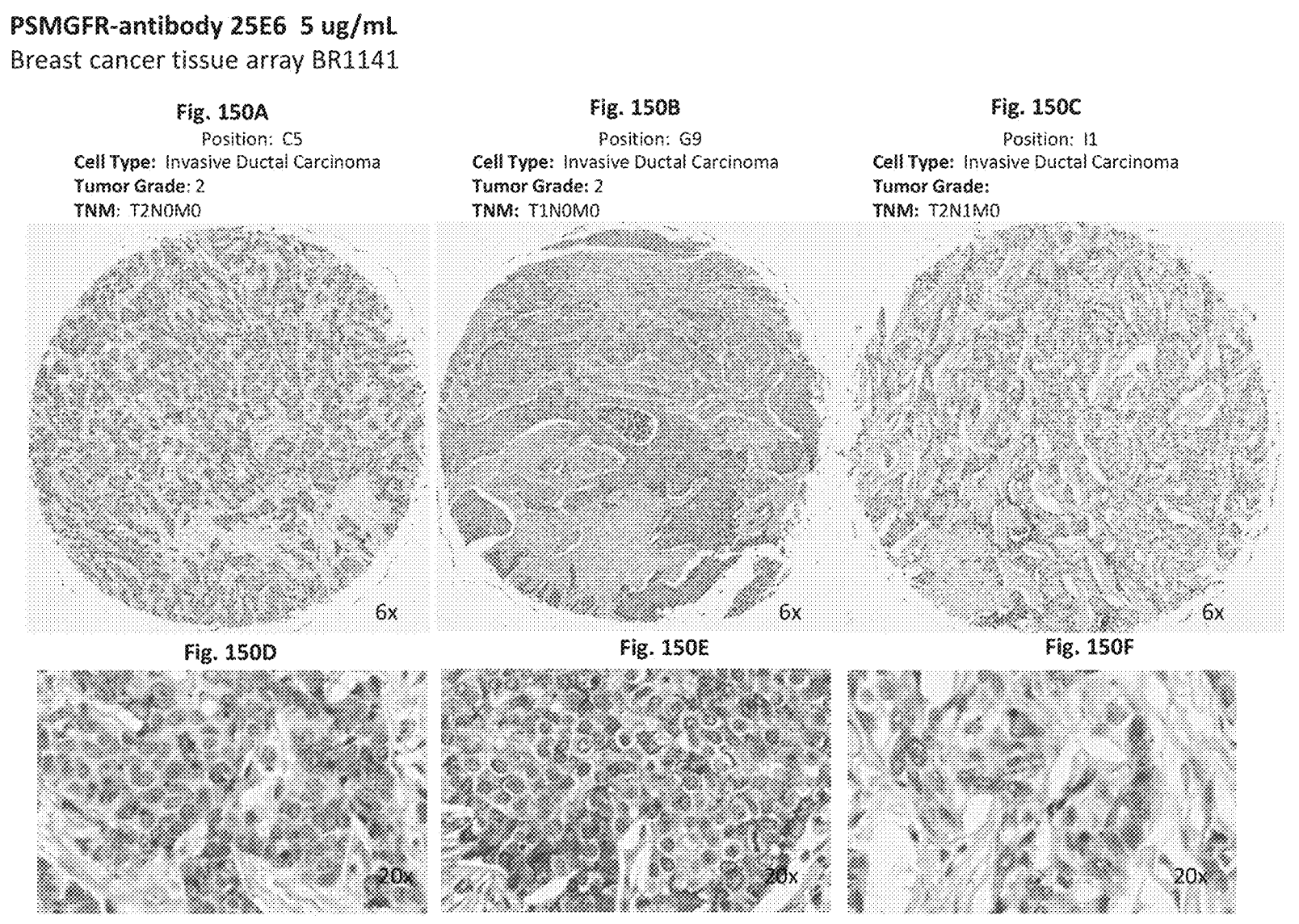

PSMGFR-antibody 25E6 5 ug/mL
Breast cancer tissue array BR1141

Fig. 150A
Position: C5
Cell Type: Invasive Ductal Carcinoma
Tumor Grade: 2
TNM: T2N0M0

Fig. 150B
Position: G9
Cell Type: Invasive Ductal Carcinoma
Tumor Grade: 2
TNM: T1N0M0

Fig. 150C
Position: I1
Cell Type: Invasive Ductal Carcinoma
Tumor Grade:
TNM: T2N1M0

PSMGFR-antibody 25E6 0.1-5 ug/mL
Pancreatic cancer tissue array PA1003

PSMGFR-antibody 25E6 0.1 ug/mL
Pancreatic cancer tissue array PA1003

Position: A2
Cell Type: Adenocarcinoma
Tumor Grade: 2
TNM: T3N0M0

Position: B2
Cell Type: Adenocarcinoma
Tumor Grade: 1
TNM: T3N0M0

Position: C2
Cell Type: Adenocarcinoma
Tumor Grade: 1
TNM: T3N0M0

PSMGFR-antibody 28F9 IgG 15 ug/mL
FDA Normal tissue array MNO1021

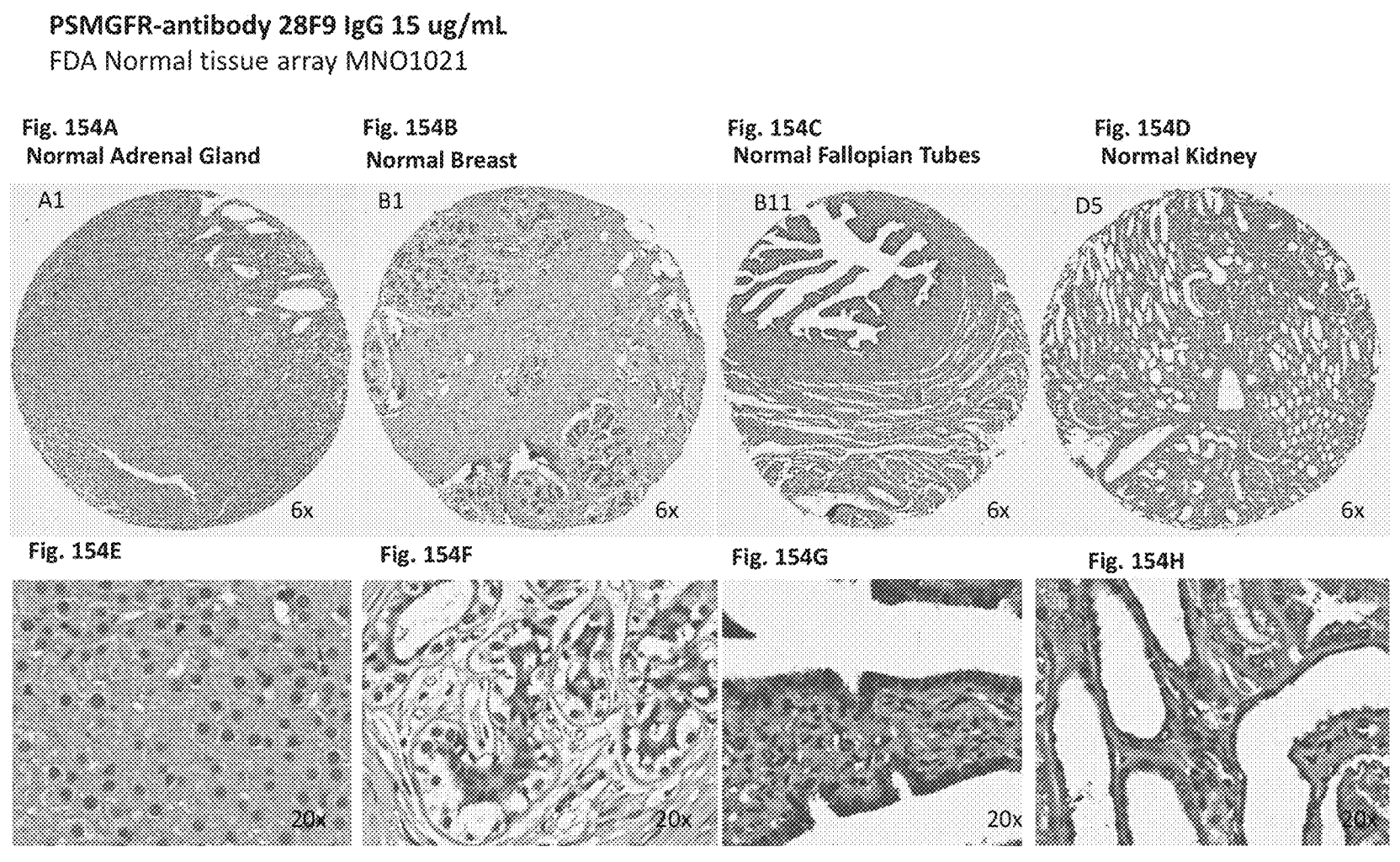

PSMGFR-antibody 28F9 IgG 15 ug/mL
FDA Normal tissue array MNO1021

Fig. 154A
Normal Adrenal Gland

Fig. 154B
Normal Breast

Fig. 154C
Normal Fallopian Tubes

Fig. 154D
Normal Kidney

PSMGFR-antibody 28F9 IgG 15 ug/mL
FDA Normal tissue array MNO1021

Normal Heart

Normal Liver

Normal Lung

Normal Ureter

PSMGFR-antibody 28F9 IgG 15 ug/mL
FDA Normal tissue array MNO1021

Normal eye

Normal Cerebral cortex

Normal Bone marrow

Normal Skeletal muscle

Fig. 155C

PSMGFR-antibody 28F9 15ug/mL
Breast cancer tissue array BR1141

PSMGFR-antibody 28F9  15ug/mL
Breast cancer tissue array BR1141

Position: C5
Cell Type: Invasive Ductal Carcinoma
Tumor Grade: 2
TNM: T2N0M0

Position: G9
Cell Type: Invasive Ductal Carcinoma
Tumor Grade: 2
TNM: T1N0M0

Position: I1
Cell Type: Invasive Ductal Carcinoma
Tumor Grade:
TNM: T2N1M0

N+20/C-27 antibody 1E4 IgG 7.5 ug/mL
FDA Normal tissue array MNO1021

Fig. 157A

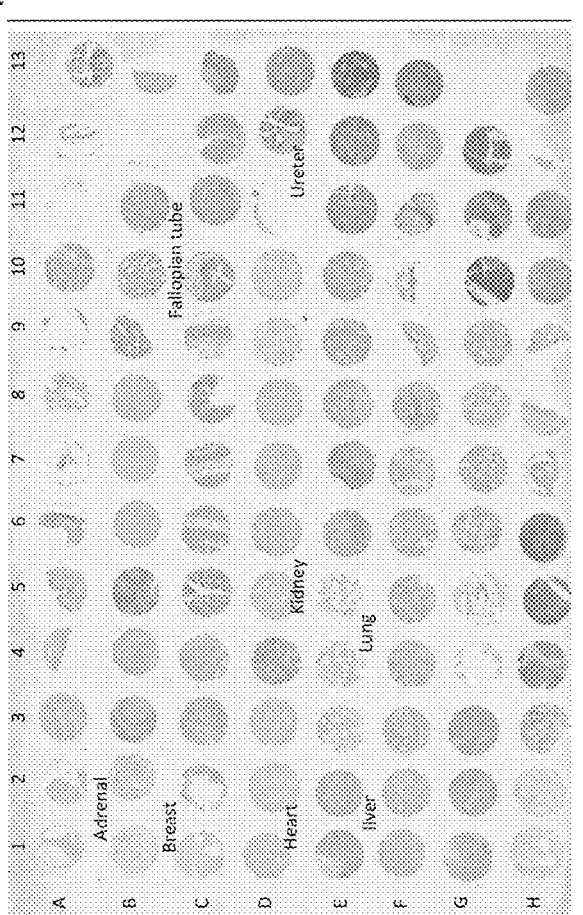

| Position | Age | Sex | Organ/Anatomic Site | Pathology diagnosis | Position | Age | Sex | Organ/Anatomic Site | Pathology diagnosis |
|---|---|---|---|---|---|---|---|---|---|
| A1 | 5 | F | Adrenal gland | Normal | E1 | 59 | M | Liver | Normal |
| A2 | 51 | M | Adrenal gland | Normal | E2 | 27 | F | Liver | Normal |
| A3 | 53 | M | Adrenal gland | Normal | E3 | 72 | M | Lung | Normal |
| A4 | 75 | M | Bladder, urinary | Normal | E4 | 55 | M | Lung | Normal |
| A5 | 72 | M | Bladder, urinary | Normal | E5 | 43 | M | Lung | Normal |
| A6 | 52 | M | Bladder, urinary | Normal | E6 | 47 | F | Ovary | Normal |
| A7 | 53 | M | Bone, bone marrow | Normal | E7 | 48 | F | Ovary | Normal |
| A8 | 43 | M | Bone, bone marrow | Normal | E8 | 40 | F | Ovary | Normal |
| A9 | 44 | M | Head and neck, salivary gland | Normal | E9 | 42 | M | Pancreas | Normal |
| A10 | 19 | M | Head and neck, salivary gland | Normal | E10 | 26 | M | Pancreas | Normal |
| A11 | 55 | M | Eye | Normal | E11 | 59 | F | Pancreas | Normal |
| A12 | 50 | M | Eye | Normal | E12 | 17 | F | Parathyroid | Adenoma |
| A13 | 35 | F | Breast | Normal | E13 | 72 | M | Parathyroid | Normal |
| B1 | 38 | F | Breast | Normal | F1 | 3 | F | Pituitary gland | Normal |
| B2 | 33 | F | Breast | Normal | F2 | 32 | F | Pituitary gland | Normal |
| B3 | 58 | M | Brain, cerebellum | Normal | F3 | 32 | F | Placenta | Normal |
| B4 | 65 | M | Brain, cerebellum | Normal | F4 | 30 | F | Placenta | Normal |
| B5 | 65 | M | Brain, cerebellum | Normal | F5 | 27 | F | Placenta | Normal |
| B6 | 58 | M | Brain, cerebral cortex | Normal | F6 | 64 | M | Prostate | Normal |
| B7 | 65 | M | Brain, cerebral cortex | Normal | F7 | 65 | M | Prostate | Normal |
| B8 | 65 | M | Brain, cerebral cortex | Normal | F8 | 65 | M | Prostate | Normal |
| B9 | 42 | F | Fallopian tube | Normal | F9 | 32 | F | Skin | Normal |
| B10 | 32 | F | Fallopian tube | Normal | F10 | 69 | F | Skin | Normal |
| B11 | 24 | F | Fallopian tube | Normal | F11 | 29 | M | Skin | Normal |
| B12 | 46 | M | Esophagus | Normal | F12 | 47 | M | Spinal cord | Normal |
| B13 | 66 | M | Esophagus | Normal | F13 | 58 | M | Spinal cord | Normal |
| C1 | 54 | M | Esophagus | Normal | G1 | 27 | M | Spleen | Normal |
| C2 | 45 | M | Stomach | Normal | G2 | 60 | M | Spleen | Normal |
| C3 | 49 | M | Stomach | Normal | G3 | 31 | M | Spleen | Normal |
| C4 | 77 | M | Stomach | Normal | G4 | 60 | F | Testis | Normal |
| C5 | 46 | M | Intestine, small intestine | Normal | G5 | 49 | M | Skeletal muscle | Normal |
| C6 | 75 | M | Intestine, small intestine | Normal | G6 | 70 | M | Skeletal muscle | Normal |
| C7 | 75 | M | Intestine, small intestine | Normal | G7 | 43 | M | Skeletal muscle | Normal |
| C8 | 2 | M | Intestine, colon | Normal | G8 | 39 | M | Testis | Normal |
| C9 | 46 | M | Intestine, colon | Normal | G9 | 77 | M | Testis | Normal |
| C10 | 74 | M | Intestine, colon | Normal | G10 | 15 | M | Thymus | Normal |
| C11 | 47 | M | Intestine, rectum | Normal | G11 | 28 | M | Thymus | Normal |
| C12 | 75 | F | Intestine, rectum | Normal | G12 | 9 | F | Thymus | Normal |
| C13 | 66 | M | Intestine, rectum | Normal | G13 | - | - | . | |
| D1 | 58 | M | Heart | Normal | H1 | 26 | F | Thyroid | Normal |
| D2 | 46 | F | Heart | Normal | H2 | 37 | F | Thyroid | Normal |
| D3 | 34 | M | Heart | Normal | H3 | 51 | F | Thyroid | Normal |
| D4 | 52 | F | Kidney, cortex | Normal | H4 | 46 | M | Tonsil | Normal |
| D5 | 23 | M | Kidney, cortex | Normal | H5 | 37 | M | Tonsil | Normal |
| D6 | 63 | M | Kidney, cortex | Normal | H6 | 13 | M | Tonsil | Normal |
| D7 | 52 | F | Kidney, medulla | Normal | H7 | 38 | F | Uterus, cervix | Normal |
| D8 | 23 | M | Kidney, medulla | Normal | H8 | 35 | F | Uterus, cervix | Normal |
| D9 | 63 | M | Peripheral nerve | Normal | H9 | 44 | F | Uterus, cervix | Normal |
| D10 | 29 | F | Peripheral nerve | Schwannoma | H10 | 38 | F | Uterus, endometrium | Normal |
| D11 | 44 | F | Ureter | Normal | H11 | 41 | F | Uterus, endometrium | Normal |
| D12 | 42 | F | Ureter | Normal | H12 | 46 | F | Uterus, endometrium | Normal |
| D13 | 57 | F | Liver | Normal | H13 | 68 | M | Skin | Malignant melanoma (tissue marker) |

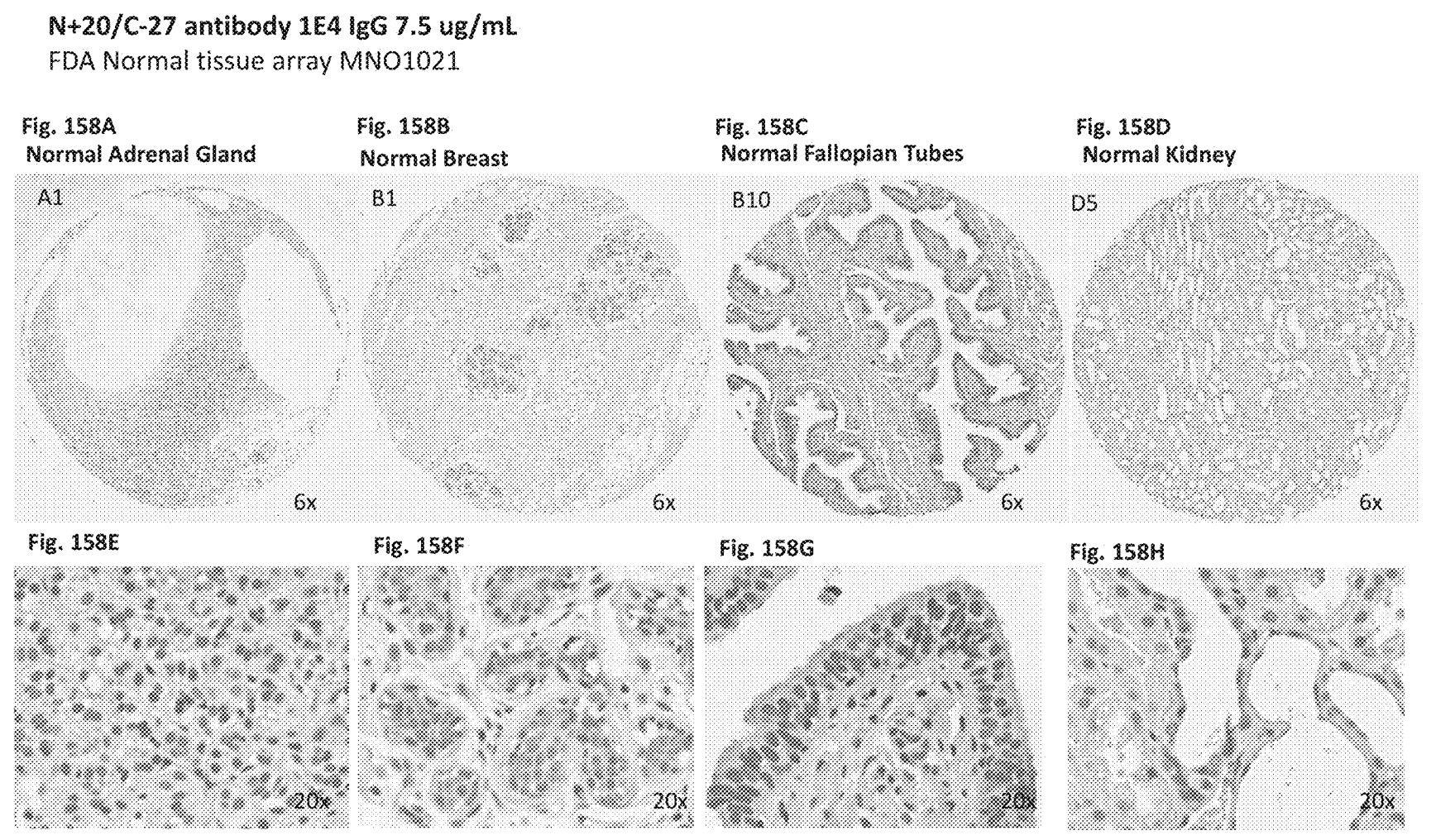

N+20/C-27 antibody 1E4 IgG 7.5 ug/mL
FDA Normal tissue array MNO1021

Fig. 158A
Normal Adrenal Gland

Fig. 158B
Normal Breast

Fig. 158C
Normal Fallopian Tubes

Fig. 158D
Normal Kidney

N+20/C-27 antibody 1E4 IgG 7.5
ug/mL
FDA Normal tissue array MNO1021

Fig. 158I
Normal Heart

Fig. 158J
Normal Liver

Fig. 158K
Normal Lung

Fig. 158L
Normal Ureter

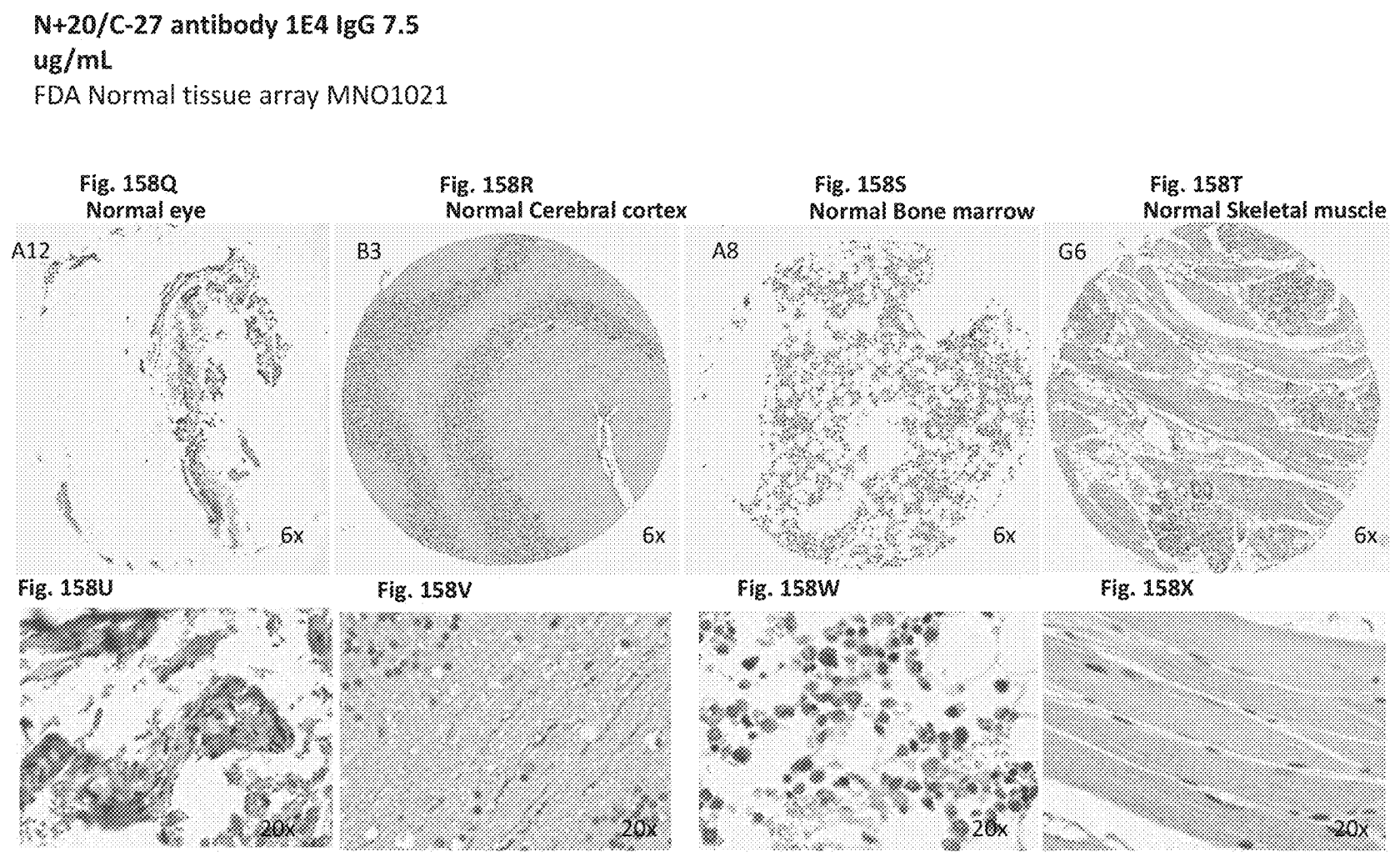

N+20/C-27 antibody 1E4 IgG 7.5 ug/mL
FDA Normal tissue array MNO1021

Fig. 158Q
Normal eye

Fig. 158R
Normal Cerebral cortex

Fig. 158S
Normal Bone marrow

Fig. 158T
Normal Skeletal muscle

N+20/C-27 antibody 1E4 IgG 10 ug/mL
Breast cancer tissue array BR1007

N+20/C-27 antibody 1E4 IgG 10 ug/mL
Breast cancer tissue array BR1007

Position: B4
Cell Type: Invasive Ductal Carcinoma
Tumor Grade: 2
TNM: T1N1M0

Position: C4
Cell Type: Invasive Ductal Carcinoma
Tumor Grade: 2
TNM: T4N0M0

Position: D5
Cell Type: Invasive Ductal Carcinoma
Tumor Grade: 2
TNM: T2N0M0

N+20/C-27 antibody 29H1 IgG 0.5 ug/mL
FDA Normal tissue array MNO1021

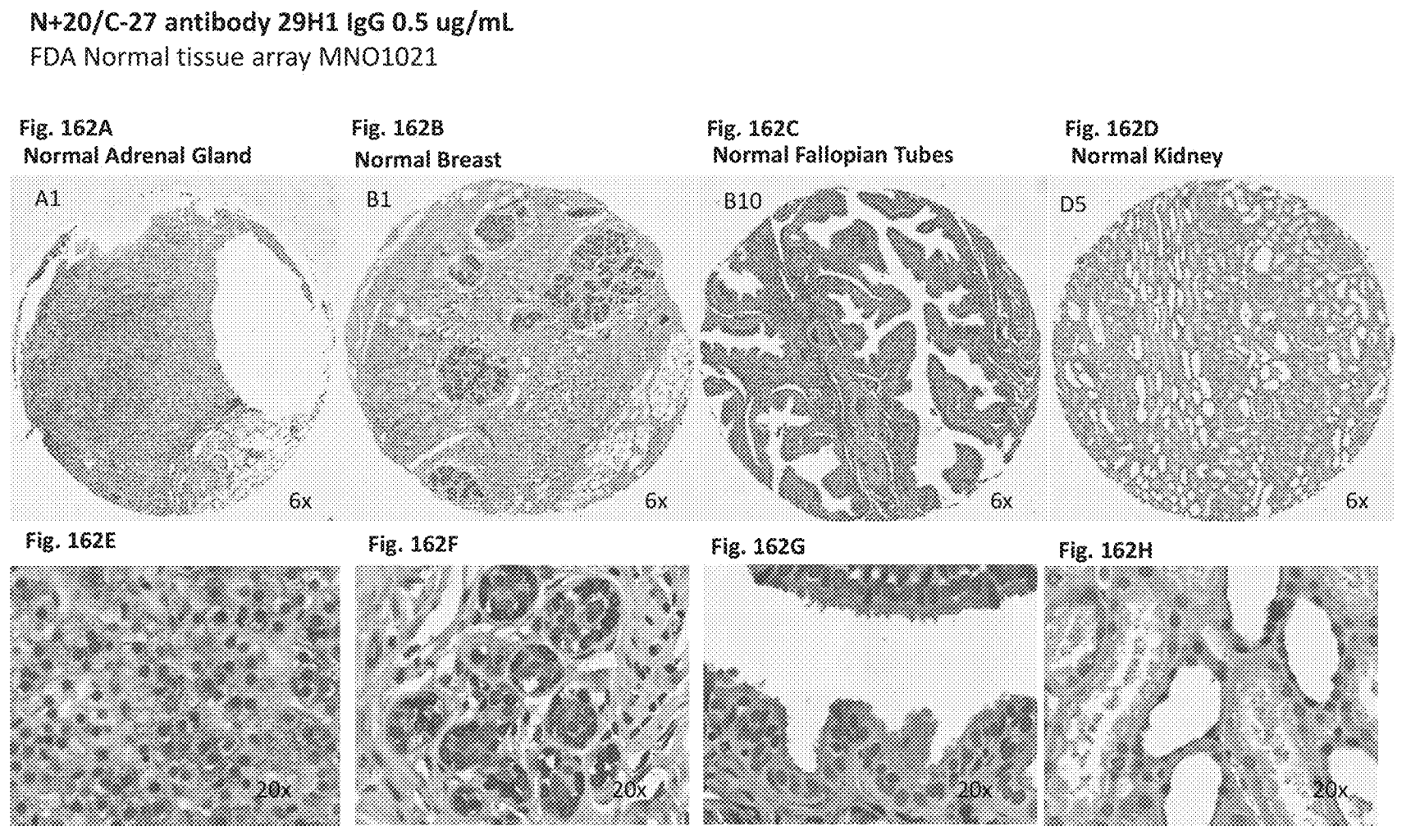

N+20/C-27 antibody 29H1 IgG 0.5 ug/mL
FDA Normal tissue array MNO1021

Fig. 162A
Normal Adrenal Gland

Fig. 162B
Normal Breast

Fig. 162C
Normal Fallopian Tubes

Fig. 162D
Normal Kidney

N+20/C-27 antibody 29H1 IgG 0.5 ug/mL
FDA Normal tissue array MNO1021

Normal Heart

Normal Liver

Normal Lung

Normal Ureter

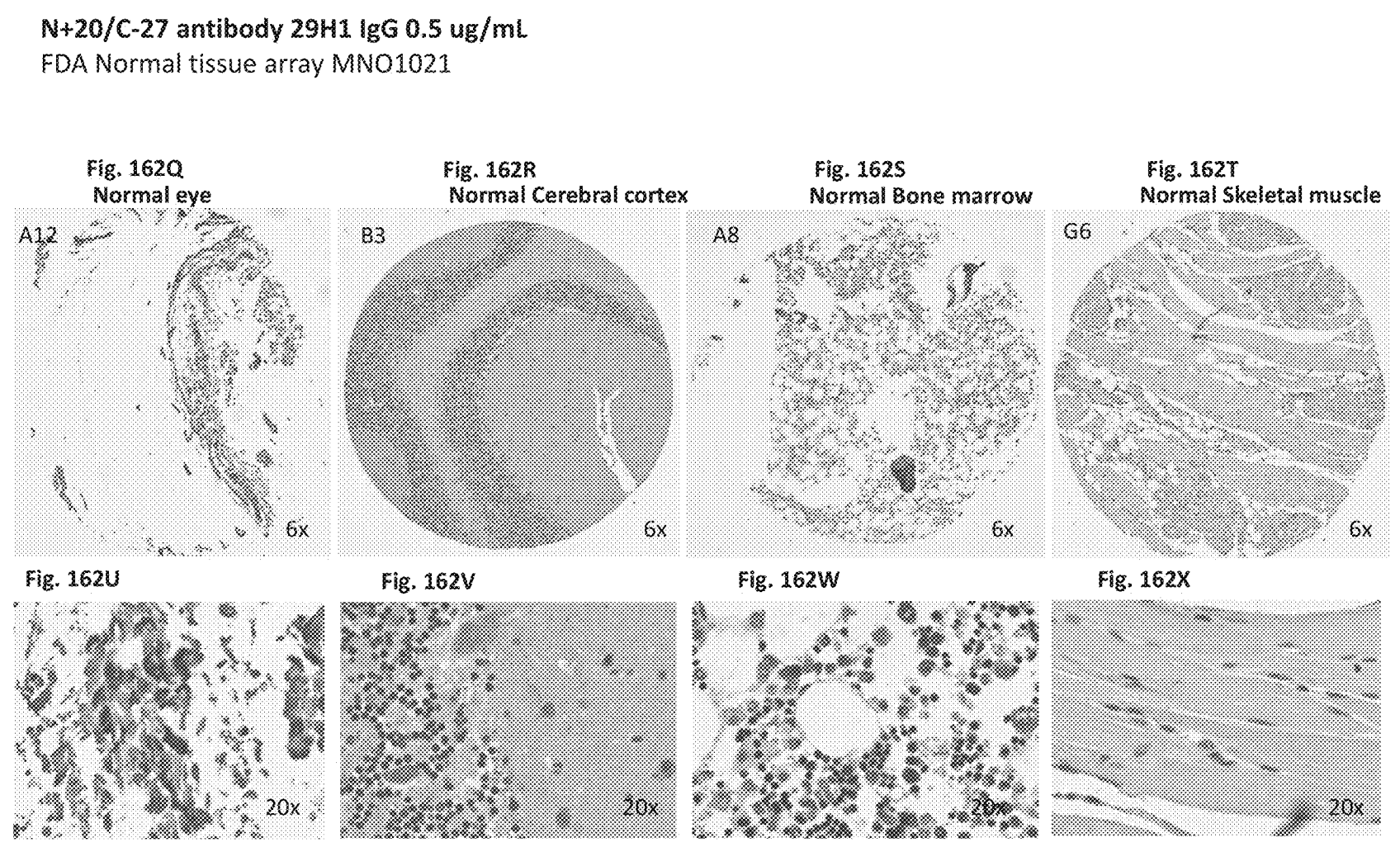

N+20/C-27 antibody 29H1 IgG 0.5 ug/mL
FDA Normal tissue array MNO1021

Fig. 162Q
Normal eye

Fig. 162R
Normal Cerebral cortex

Fig. 162S
Normal Bone marrow

Fig. 162T
Normal Skeletal muscle

N+20/C-27 antibody 29H1 IgG 0.5 ug/mL
Breast cancer tissue array Br1141

N+20/C-27 antibody 29H1 IgG 0.5ug/mL
Breast cancer tissue array Br1141

Fig. 164A          Position: A4

Cell Type: Invasive Ductal Carcinoma
Tumor Grade: 2
TNM: T2N0M0

Fig. 164B          Position: A11

Cell Type: Invasive Ductal Carcinoma
Tumor Grade: 2
TNM: T2N0M0

Fig. 164C          Position: G11

Cell Type: Invasive Ductal Carcinoma
Tumor Grade: 2
TNM: T2N0M0

Fig. 165C

N+20/C-27-antibody 29H1  0.1 - 4 ug/mL
Pancreatic cancer tissue array PA1003

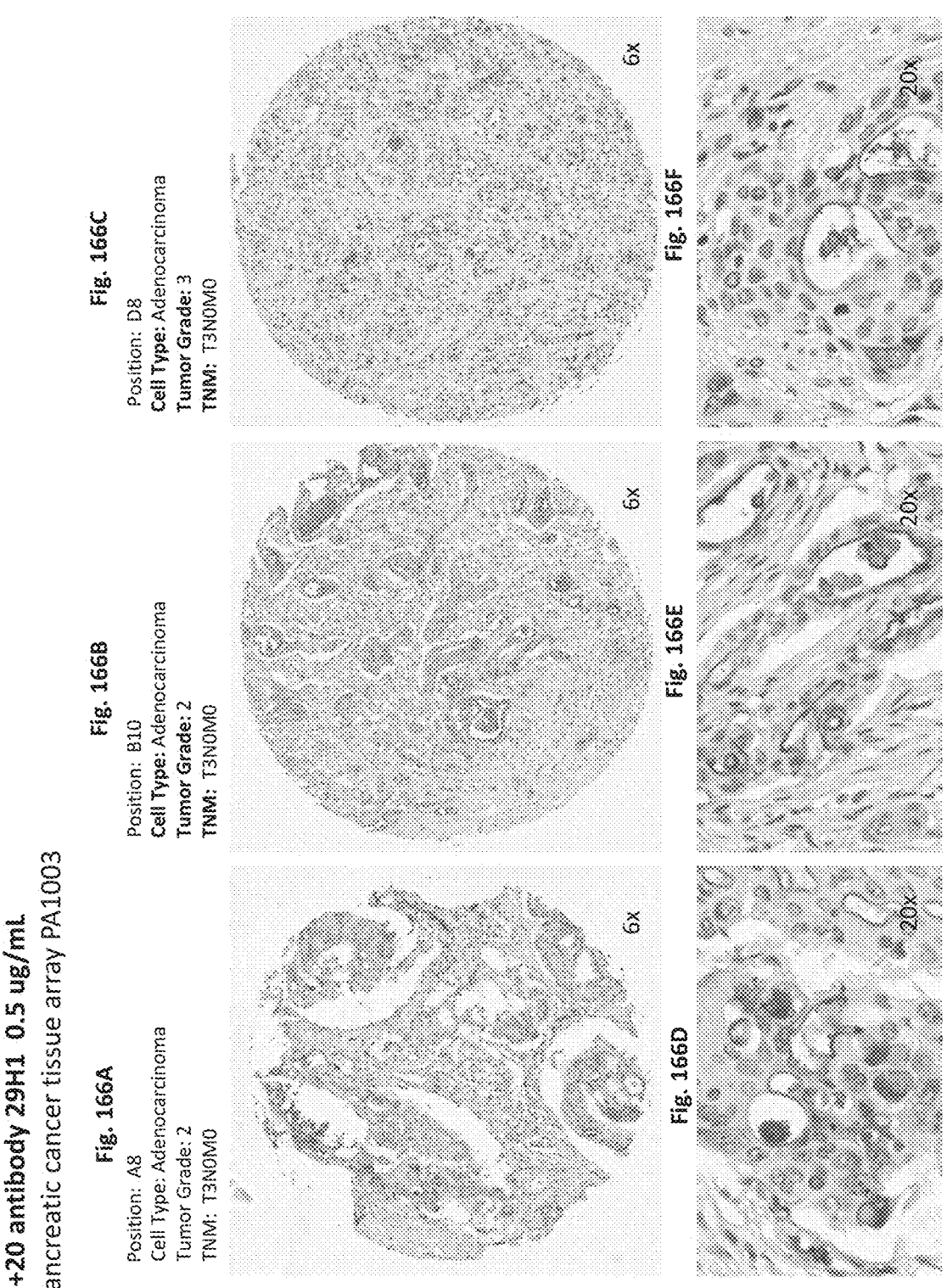

N+20/C-27 antibody 31A1 IgG 0.5 ug/mL
FDA Normal tissue array MNO1021

| Position | Age | Sex | Organ/Anatomic Site | Pathology diagnosis | Position | Age | Sex | Organ/Anatomic Site | Pathology diagnosis |
|---|---|---|---|---|---|---|---|---|---|
| A1 | 31 | F | Adrenal gland | Normal | E1 | 59 | M | Liver | Normal |
| A2 | 51 | M | Adrenal gland | Normal | E2 | 27 | F | Liver | Normal |
| A3 | 63 | M | Adrenal gland | Normal | E3 | 72 | M | Lung | Normal |
| A4 | 75 | M | Bladder, urinary | Normal | E4 | 55 | M | Lung | Normal |
| A5 | 72 | M | Bladder, urinary | Normal | E5 | 43 | M | Lung | Normal |
| A6 | 52 | M | Bladder, urinary | Normal | E6 | 47 | F | Ovary | Normal |
| A7 | 53 | M | Bone, bone marrow | Normal | E7 | 46 | F | Ovary | Normal |
| A8 | 43 | M | Bone, bone marrow | Normal | E8 | 40 | F | Ovary | Normal |
| A9 | 44 | F | Head and neck, salivary gland | Normal | E9 | 42 | M | Pancreas | Normal |
| A10 | 19 | M | Head and neck, salivary gland | Normal | E10 | 26 | M | Pancreas | Normal |
| A11 | 55 | M | Eye | Normal | E11 | 59 | M | Pancreas | Normal |
| A12 | 60 | M | Eye | Normal | E12 | 17 | F | Parathyroid | Adenoma |
| A13 | 35 | F | Breast | Normal | E13 | 72 | F | Parathyroid | Adenoma |
| B1 | 38 | F | Breast | Normal | F1 | 3 | F | Pituitary gland | Normal |
| B2 | 33 | F | Breast | Normal | F2 | 32 | F | Pituitary gland | Normal |
| B3 | 58 | M | Brain, cerebellum | Normal | F3 | 30 | F | Placenta | Normal |
| B4 | 65 | M | Brain, cerebellum | Normal | F4 | 27 | F | Placenta | Normal |
| B5 | | | Brain, cerebellum | Normal | F5 | 65 | M | Prostate | Normal |
| B6 | 59 | M | Brain, cerebral cortex | Normal | F6 | 64 | M | Prostate | Normal |
| B7 | 65 | F | Brain, cerebral cortex | Normal | F7 | 65 | M | Prostate | Normal |
| B8 | | | Brain, cerebral cortex | Normal | F8 | 65 | F | Skin | Normal |
| B9 | 42 | F | Fallopian tube | Normal | F9 | 32 | F | Skin | Normal |
| B10 | 32 | F | Fallopian tube | Normal | F10 | 68 | M | Skin | Normal |
| B11 | 24 | F | Fallopian tube | Normal | F11 | 29 | M | Skin | Normal |
| B12 | 45 | M | Esophagus | Normal | F12 | 47 | M | Spinal cord | Normal |
| B13 | 68 | M | Esophagus | Normal | F13 | 58 | M | Spinal cord | Normal |
| C1 | 54 | M | Esophagus | Normal | G1 | 27 | M | Spleen | Normal |
| C2 | 45 | M | Stomach | Normal | G2 | 60 | M | Spleen | Normal |
| C3 | 49 | M | Stomach | Normal | G3 | 31 | M | Spleen | Normal |
| C4 | 77 | M | Stomach | Normal | G4 | 60 | F | Skeletal muscle | Normal |
| C5 | 46 | M | Intestine, small intestine | Normal | G5 | 49 | M | Skeletal muscle | Normal |
| C6 | 75 | M | Intestine, small intestine | Normal | G6 | 70 | M | Skeletal muscle | Normal |
| C7 | 75 | M | Intestine, small intestine | Normal | G7 | 43 | M | Testis | Normal |
| C8 | 2 | M | Intestine, colon | Normal | G8 | 30 | M | Testis | Normal |
| C9 | 46 | M | Intestine, colon | Normal | G9 | 77 | M | Testis | Normal |
| C10 | 74 | M | Intestine, colon | Normal | G10 | 15 | M | Thymus | Normal |
| C11 | 47 | F | Intestine, rectum | Normal | G11 | 28 | M | Thymus | Normal |
| C12 | 75 | M | Intestine, rectum | Normal | G12 | 9 | F | Thymus | , |
| C13 | 86 | M | Intestine, rectum | Normal | G13 | | | | |
| D1 | 58 | M | Heart | Normal | H1 | 28 | M | Thyroid | Normal |
| D2 | 46 | M | Heart | Normal | H2 | 37 | F | Thyroid | Normal |
| D3 | 34 | M | Heart | Normal | H3 | 51 | M | Thyroid | Normal |
| D4 | 52 | M | Kidney, cortex | Normal | H4 | 46 | M | Tonsil | Normal |
| D5 | 23 | M | Kidney, cortex | Normal | H5 | 37 | M | Tonsil | Normal |
| D6 | 63 | M | Kidney, cortex | Normal | H6 | 13 | M | Tonsil | Normal |
| D7 | 52 | M | Kidney, medulla | Normal | H7 | 38 | F | Uterus, cervix | Normal |
| D8 | 23 | M | Kidney, medulla | Normal | H8 | 35 | F | Uterus, cervix | Normal |
| D9 | 59 | M | Peripheral nerve | Normal | H9 | 44 | F | Uterus, cervix | Normal |
| D10 | 29 | F | Peripheral nerve | Schwannoma | H10 | 38 | F | Uterus, endometrium | Normal |
| D11 | 44 | F | Ureter | Normal | H11 | 41 | F | Uterus, endometrium | Normal |
| D12 | 42 | F | Ureter | Normal | H12 | 46 | F | Uterus, endometrium | Normal |
| D13 | 57 | F | Liver | Normal | H13 | 58 | M | Skin | Malignant melanoma (tissue marker) |

Figure 167A-167C

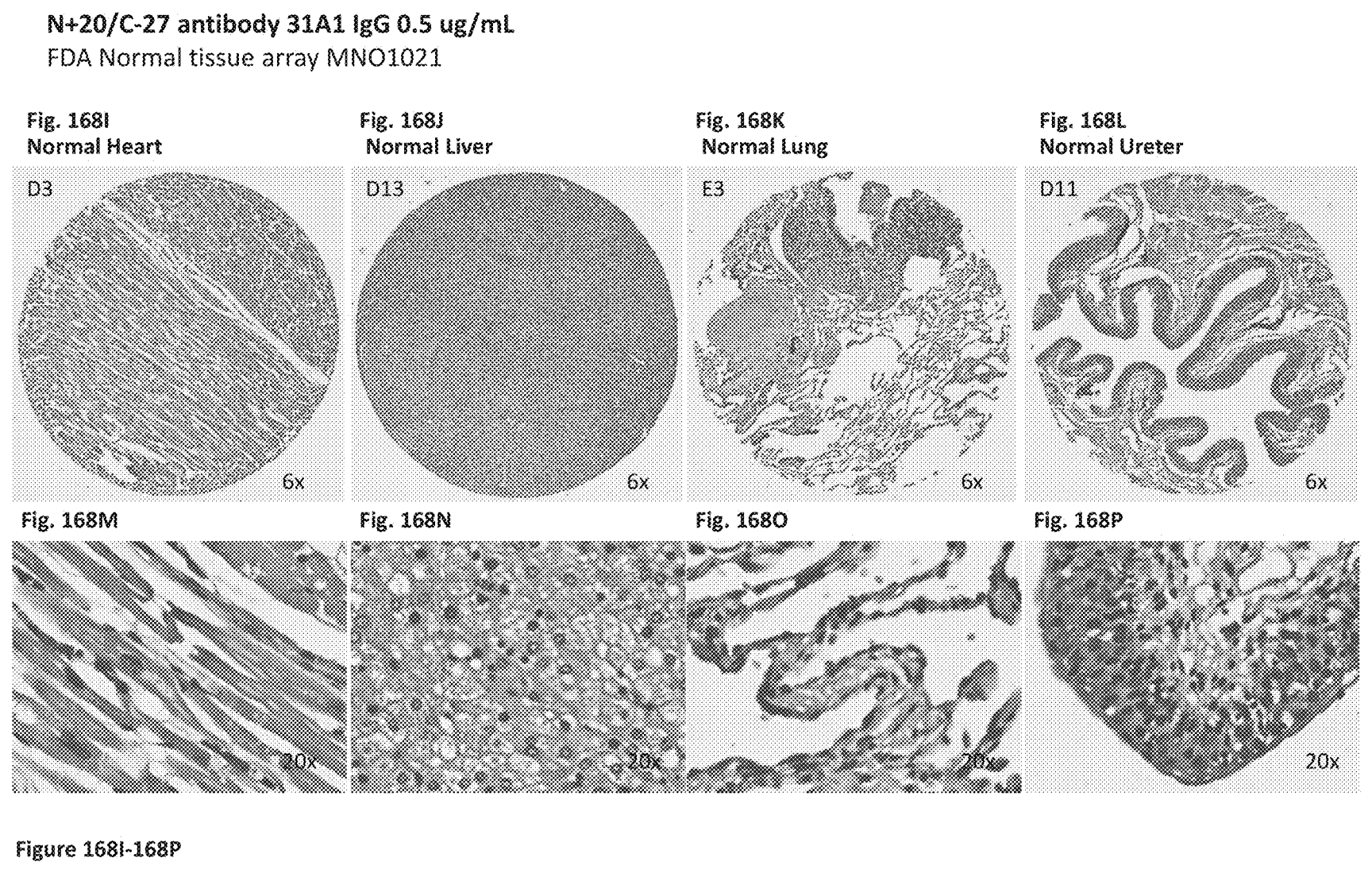

N+20/C-27 antibody 31A1 IgG 0.5 ug/mL
FDA Normal tissue array MNO1021

Fig. 168I
Normal Heart

Fig. 168J
Normal Liver

Fig. 168K
Normal Lung

Fig. 168L
Normal Ureter

N+20/C-27 antibody 31A1 IgG 0.5 ug/mL
FDA Normal tissue array MNO1021

Normal Eye

Normal Cerebral Cortex

Normal Bone Marrow

Normal Skeletal Muscle

N+20/C-27 antibody 31A1 IgG 0.5 ug/mL
Breast cancer tissue array Br1141

N+20/C-27 antibody 31A1 IgG 15 ug/mL
Breast cancer tissue array Br1141

Position: A4
Cell Type: Invasive Ductal Carcinoma
Tumor Grade: 2
TNM: T2N0M0

Position: A11
Cell Type: Invasive Ductal Carcinoma
Tumor Grade: 2
TNM: T2N0M0

Position: G11
Cell Type: Invasive Ductal Carcinoma
Tumor Grade: 2
TNM: T2N0M0

N+20 antibody 31A1  0.1 - 10 ug/mL
Pancreatic cancer tissue array PA1003

N+20/C-27-antibody 31A1  1 ug/mL
Pancreatic cancer tissue array PA1003

Position: B7
Cell Type: Adenocarcinoma
Tumor Grade: 1
TNM: T3N0M0

Position: B10
Cell Type: Adenocarcinoma
Tumor Grade: 2
TNM: T3N0M0

Position: D8
Cell Type: Adenocarcinoma
Tumor Grade: 3
TNM: T3N0M0

N+20/C-27 antibody 32C1 IgG 0.25 ug/mL
FDA Normal tissue array MNO1021

| Position | Age | Sex | Organ/Anatomic Site | Pathology diagnosis |
|---|---|---|---|---|
| A1 | F | 31 | Adrenal gland | Normal |
| A2 | M | 51 | Adrenal gland | Normal |
| A3 | M | 53 | Adrenal gland | Normal |
| A4 | M | 75 | Bladder, urinary | Normal |
| A5 | M | 72 | Bladder, urinary | Normal |
| A6 | M | 52 | Bladder, urinary | Normal |
| A7 | M | 43 | Bone, bone marrow | Normal |
| A8 | M | 44 | Bone, bone marrow | Normal |
| A9 | F | 18 | Head and neck, salivary gland | Normal |
| A10 | M | 55 | Head and neck, salivary gland | Normal |
| A11 | M | 55 | Eye | Normal |
| A12 | F | 56 | Eye | Normal |
| A13 | M | 35 | Breast | Normal |
| B1 | F | 38 | Breast | Normal |
| B2 | F | 33 | Breast | Normal |
| B3 | M | 58 | Brain, cerebellum | Normal |
| B4 | M | 65 | Brain, cerebellum | Normal |
| B5 | F | | Brain, cerebellum | Normal |
| B6 | M | 58 | Brain, cerebral cortex | Normal |
| B7 | M | 65 | Brain, cerebral cortex | Normal |
| B8 | F | | Brain, cerebral cortex | Normal |
| B9 | F | 42 | Fallopian tube | Normal |
| B10 | F | 32 | Fallopian tube | Normal |
| B11 | F | 24 | Fallopian tube | Normal |
| B12 | M | 45 | Esophagus | Normal |
| B13 | M | 68 | Esophagus | Normal |
| C1 | M | 54 | Esophagus | Normal |
| C2 | M | 45 | Stomach | Normal |
| C3 | M | 49 | Stomach | Normal |
| C4 | M | 77 | Stomach | Normal |
| C5 | M | 45 | Intestine, small intestine | Normal |
| C6 | M | 75 | Intestine, small intestine | Normal |
| C7 | M | 75 | Intestine, small intestine | Normal |
| C8 | F | 2 | Intestine, colon | Normal |
| C9 | M | 46 | Intestine, colon | Normal |
| C10 | M | 74 | Intestine, colon | Normal |
| C11 | F | 47 | Intestine, rectum | Normal |
| C12 | F | 75 | Intestine, rectum | Normal |
| C13 | F | 66 | Intestine, rectum | Normal |
| D1 | M | 58 | Heart | Normal |
| D2 | M | 46 | Heart | Normal |
| D3 | M | 34 | Heart | Normal |
| D4 | M | 52 | Kidney, cortex | Normal |
| D5 | M | 25 | Kidney, cortex | Normal |
| D6 | F | 63 | Kidney, cortex | Normal |
| D7 | M | 52 | Kidney, medulla | Normal |
| D8 | M | 23 | Kidney, medulla | Normal |
| D9 | M | 59 | Peripheral nerve | Normal |
| D10 | F | 29 | Peripheral nerve | Schwannoma |
| D11 | F | 44 | Ureter | Normal |
| D12 | F | 42 | Ureter | Normal |
| D13 | F | 57 | Liver | Normal |

| Position | Age | Sex | Organ/Anatomic Site | Pathology diagnosis |
|---|---|---|---|---|
| E1 | M | 59 | Liver | Normal |
| E2 | F | 27 | Liver | Normal |
| E3 | M | 72 | Lung | Normal |
| E4 | M | 35 | Lung | Normal |
| E5 | M | 43 | Lung | Normal |
| E6 | F | 47 | Ovary | Normal |
| E7 | F | 46 | Ovary | Normal |
| E8 | F | 40 | Ovary | Normal |
| E9 | M | 42 | Pancreas | Normal |
| E10 | F | 26 | Pancreas | Normal |
| E11 | F | 26 | Pancreas | Normal |
| E12 | M | 59 | Pancreas | Adenoma |
| E13 | M | 17 | Parathyroid | Adenoma |
| F1 | F | 72 | Parathyroid | Normal |
| F2 | F | 3 | Pituitary gland | Normal |
| F3 | F | | Pituitary gland | Normal |
| F4 | F | 32 | Placenta | Normal |
| F5 | F | 30 | Placenta | Normal |
| F6 | F | 27 | Placenta | Normal |
| F7 | M | 64 | Prostate | Normal |
| F8 | M | 65 | Prostate | Normal |
| F9 | M | 65 | Prostate | Normal |
| F10 | F | 32 | Skin | Normal |
| F11 | M | 68 | Skin | Normal |
| F12 | M | 28 | Skin | Normal |
| F13 | M | 47 | Spinal cord | Normal |
| G1 | M | 58 | Spinal cord | Normal |
| G2 | M | 27 | Spleen | Normal |
| G3 | M | 60 | Spleen | Normal |
| G4 | M | 31 | Spleen | Normal |
| G5 | M | 60 | Skeletal muscle | Normal |
| G6 | F | 49 | Skeletal muscle | Normal |
| G7 | M | 70 | Skeletal muscle | Normal |
| G8 | M | 43 | Testis | Normal |
| G9 | M | 30 | Testis | Normal |
| G10 | M | 77 | Testis | Normal |
| G11 | F | 15 | Thymus | Normal |
| G12 | M | 28 | Thymus | Normal |
| G13 | F | 9 | Thymus | Normal |
| H1 | F | 28 | Thyroid | Normal |
| H2 | F | 37 | Thyroid | Normal |
| H3 | F | 51 | Thyroid | Normal |
| H4 | M | 46 | Tonsil | Normal |
| H5 | M | 37 | Tonsil | Normal |
| H6 | M | 13 | Tonsil | Normal |
| H7 | F | 35 | Uterus, cervix | Normal |
| H8 | F | 35 | Uterus, cervix | Normal |
| H9 | F | 44 | Uterus, cervix | Normal |
| H10 | F | 38 | Uterus, endometrium | Normal |
| H11 | F | 41 | Uterus, endometrium | Normal |
| H12 | F | 46 | Uterus, endometrium | Normal |
| H13 | M | 58 | Skin | Malignant melanoma (tissue marker) |

Figure 173A-173C

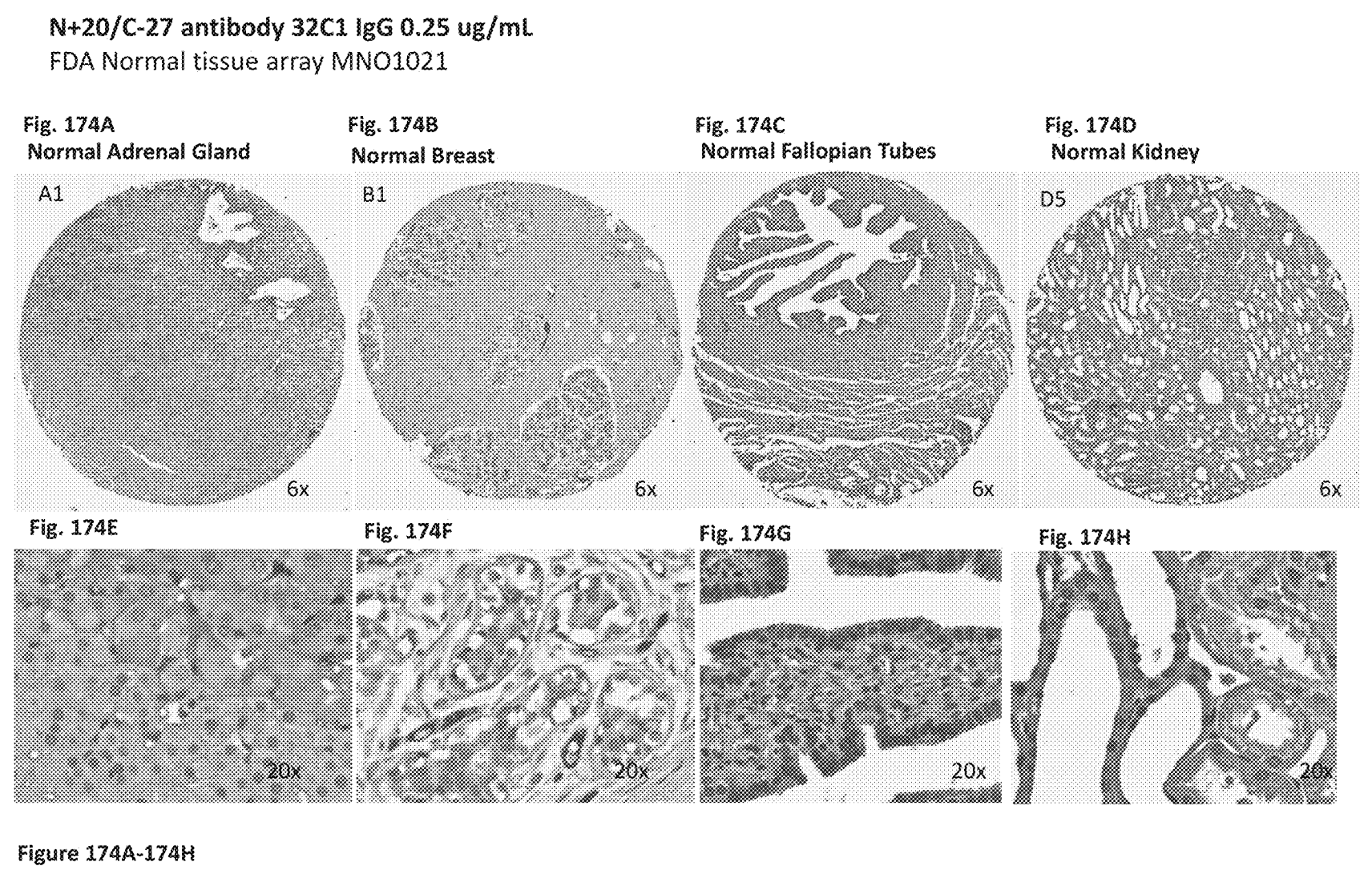

N+20/C-27 antibody 32C1 IgG 0.25 ug/mL
FDA Normal tissue array MNO1021

Fig. 174A
Normal Adrenal Gland

Fig. 174B
Normal Breast

Fig. 174C
Normal Fallopian Tubes

Fig. 174D
Normal Kidney

N+20/C-27 antibody 32C1 IgG 0.25 ug/mL
FDA Normal tissue array MNO1021

Normal Heart

Normal Liver

Normal Lung

Normal Ureter

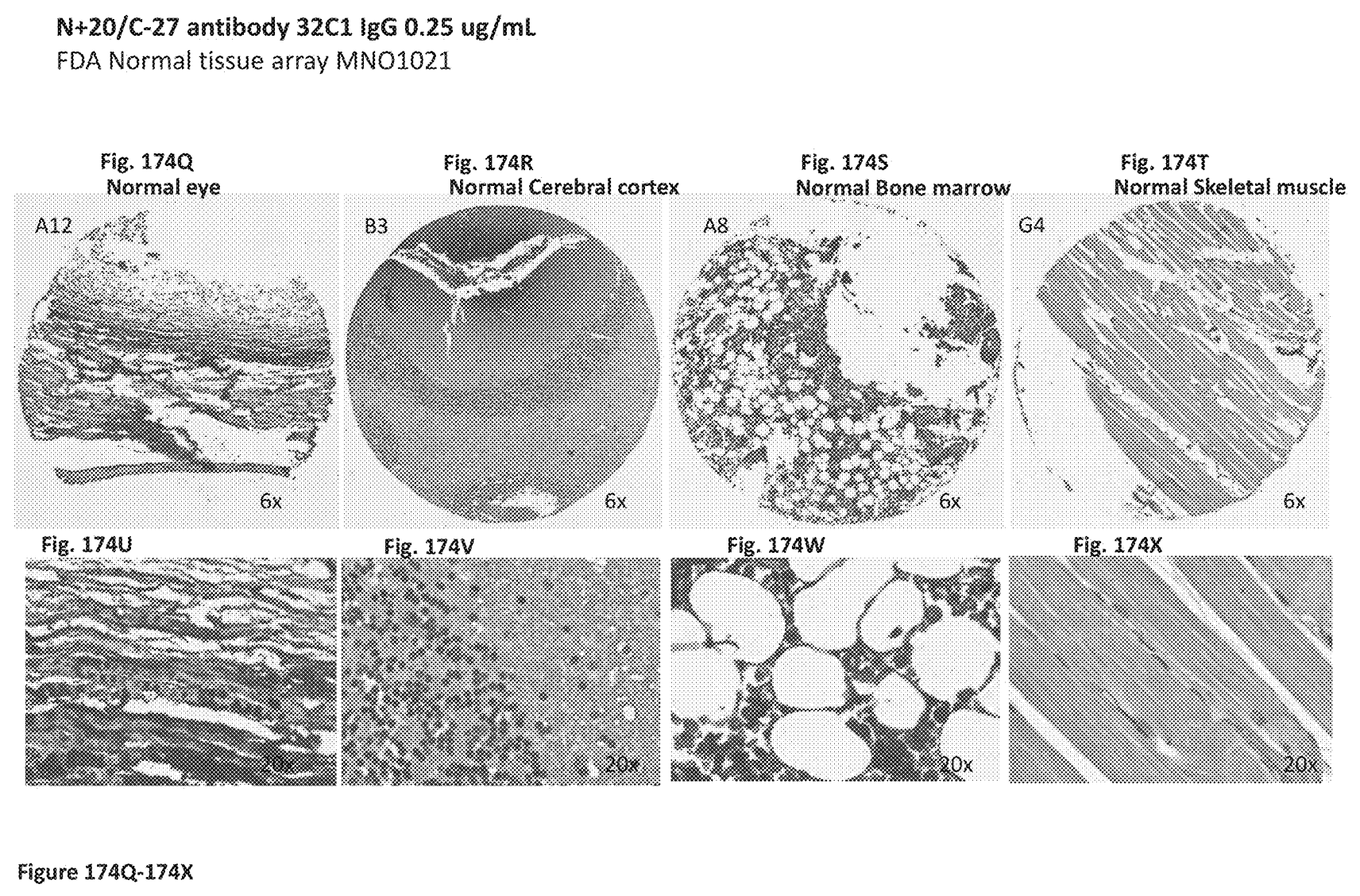

N+20/C-27 antibody 32C1 IgG 0.25 ug/mL
FDA Normal tissue array MNO1021

Fig. 174Q
Normal eye

Fig. 174R
Normal Cerebral cortex

Fig. 174S
Normal Bone marrow

Fig. 174T
Normal Skeletal muscle

N+20/C-27 antibody 32C1 IgG 0.25 ug/mL
Breast cancer tissue array Br1141

N+20/C-27 antibody 32C1 IgG 0.25 ug/mL
Breast cancer tissue array Br1141

Fig. 176A    Position: B1

Cell Type: Invasive Ductal Carcinoma
Tumor Grade: 2
TNM: T2N0M0

Fig. 176B    Position: B8

Cell Type: Invasive Ductal Carcinoma
Tumor Grade: 2
TNM: T2N0M0

Fig. 176C    Position: G11

Cell Type: Invasive Ductal Carcinoma
Tumor Grade: 2
TNM: T2N0M0

N+20/C-27 antibody 32C1 IgG 1-15 ug/mL
Esophageal cancer tissue array ES1001
Fig. 177A
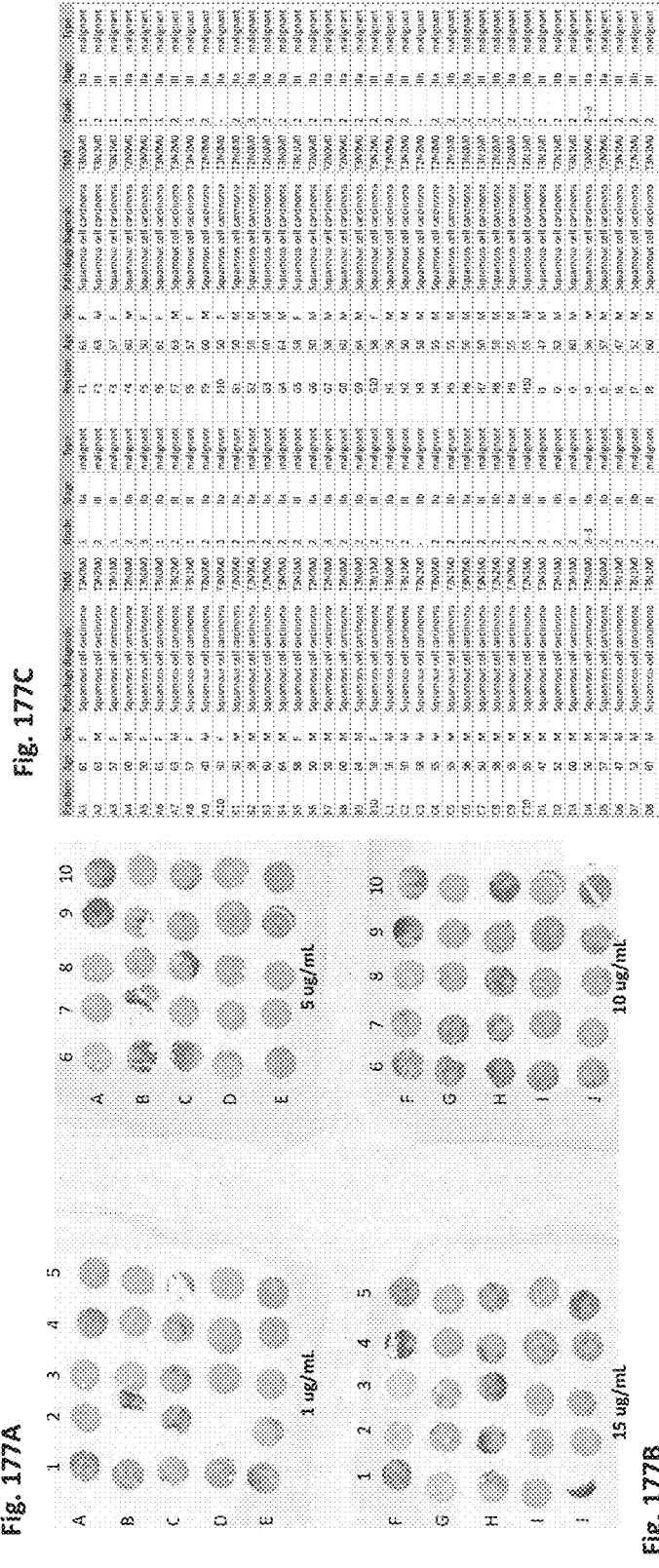
Fig. 177C
Fig. 177B
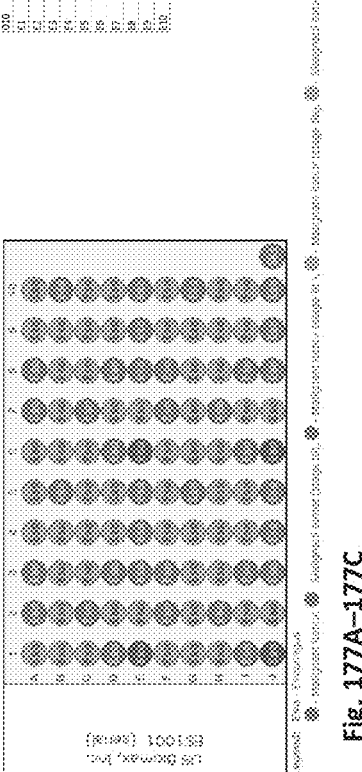
Fig. 177A–177C N+20/C-27 antibody 32C1 IgG 1 ug/mL
Esophageal cancer tissue array ES1001

Position: D1
Cell Type: Squamous cell carcinoma
Tumor Grade: 2
TNM: T3N1M0

Position: E4
Cell Type: Adenocarcinoma
Tumor Grade: 2
TNM: T3N1M0

Position: E5
Cell Type: Squamous cell carcinoma
Tumor Grade: 3
TNM: T3N1M0

Fig. 178A~178F

N+20/C-27 antibody 45C11 IgG 12.5 ug/mL
FDA Normal tissue array MNO1021

| Position | Age | Sex | Organ/Anatomic Site | Pathology diagnosis | | Position | Age | Sex | Organ/Anatomic Site | Pathology diagnosis |
|---|---|---|---|---|---|---|---|---|---|---|
| A1 | 31 | F | Adrenal gland | Normal | | E1 | 59 | M | Liver | Normal |
| A2 | 51 | M | Adrenal gland | Normal | | E2 | 27 | F | Liver | Normal |
| A3 | 53 | M | Adrenal gland | Normal | | E3 | 72 | M | Lung | Normal |
| A4 | 75 | M | Bladder, urinary | Normal | | E4 | 55 | M | Lung | Normal |
| A5 | 72 | M | Bladder, urinary | Normal | | E5 | 43 | M | Lung | Normal |
| A6 | 52 | M | Bladder, urinary | Normal | | E6 | 47 | F | Ovary | Normal |
| A7 | 53 | F | Bone, bone marrow | Normal | | E7 | 46 | F | Ovary | Normal |
| A8 | 43 | M | Bone, bone marrow | Normal | | E8 | 40 | F | Ovary | Normal |
| A9 | 44 | F | Head and neck, salivary gland | Normal | | E9 | 42 | M | Pancreas | Normal |
| A10 | 18 | M | Head and neck, salivary gland | Normal | | E10 | 25 | M | Pancreas | Normal |
| A11 | 55 | F | Eye | Normal | | E11 | 59 | F | Pancreas | Normal |
| A12 | 50 | M | Eye | Normal | | E12 | 17 | M | Parathyroid | Adenoma |
| A13 | 35 | M | Breast | Normal | | E13 | 72 | F | Parathyroid | Normal |
| B1 | 38 | F | Breast | Normal | | F1 | 5 | M | Pituitary gland | Normal |
| B2 | 33 | F | Breast | Normal | | F2 | | | Pituitary gland | Normal |
| B3 | 58 | M | Brain, cerebellum | Normal | | F3 | 32 | F | Placenta | Normal |
| B4 | 65 | M | Brain, cerebellum | Normal | | F4 | 30 | F | Placenta | Normal |
| B5 | 75 | F | Brain, cerebellum | Normal | | F5 | 27 | F | Placenta | Normal |
| B6 | 68 | M | Brain, cerebral cortex | Normal | | F6 | 64 | M | Prostate | Normal |
| B7 | 65 | M | Brain, cerebral cortex | Normal | | F7 | 65 | M | Prostate | Normal |
| B8 | | M | Brain, cerebral cortex | Normal | | F8 | 65 | M | Prostate | Normal |
| B9 | 42 | F | Fallopian tube | Normal | | F9 | 32 | F | Skin | Normal |
| B10 | 32 | F | Fallopian tube | Normal | | F10 | 68 | M | Skin | Normal |
| B11 | 24 | F | Fallopian tube | Normal | | F11 | 28 | M | Skin | Normal |
| B12 | 68 | M | Esophagus | Normal | | F12 | 47 | M | Spinal cord | Normal |
| B13 | 84 | M | Esophagus | Normal | | F13 | 58 | M | Spinal cord | Normal |
| C1 | 84 | M | Esophagus | Normal | | G1 | 27 | M | Spleen | Normal |
| C2 | 48 | M | Stomach | Normal | | G2 | 60 | M | Spleen | Normal |
| C3 | 49 | M | Stomach | Normal | | G3 | 31 | M | Spleen | Normal |
| C4 | 77 | M | Stomach | Normal | | G4 | 60 | F | Skeletal muscle | Normal |
| C5 | 46 | M | Intestine, small intestine | Normal | | G5 | 49 | M | Skeletal muscle | Normal |
| C6 | 81 | M | Intestine, small intestine | Normal | | G6 | 70 | M | Skeletal muscle | Normal |
| C7 | 75 | F | Intestine, small intestine | Normal | | G7 | 43 | M | Testis | Normal |
| C8 | 2 | M | Intestine, colon | Normal | | G8 | 30 | M | Testis | Normal |
| C9 | 46 | M | Intestine, colon | Normal | | G9 | 77 | M | Testis | Normal |
| C10 | 74 | F | Intestine, rectum | Normal | | G10 | 15 | M | Thymus | Normal |
| C11 | 47 | M | Intestine, rectum | Normal | | G11 | 26 | M | Thymus | Normal |
| C12 | 75 | F | Intestine, rectum | Normal | | G12 | 9 | M | Thymus | Normal |
| C13 | 66 | M | Intestine, rectum | Normal | | G13 | | | | |
| D1 | 58 | M | Heart | Normal | | H1 | 26 | F | Thyroid | Normal |
| D2 | 48 | M | Heart | Normal | | H2 | 37 | M | Thyroid | Normal |
| D3 | 34 | M | Heart | Normal | | H3 | 51 | M | Thyroid | Normal |
| D4 | 52 | M | Kidney, cortex | Normal | | H4 | 46 | M | Tonsil | Normal |
| D5 | 23 | M | Kidney, cortex | Normal | | H5 | 37 | M | Tonsil | Normal |
| D6 | 60 | M | Kidney, cortex | Normal | | H6 | 13 | M | Tonsil | Normal |
| D7 | 55 | M | Kidney, medulla | Normal | | H7 | 38 | F | Uterus, cervix | Normal |
| D8 | 23 | M | Kidney, medulla | Normal | | H8 | 35 | F | Uterus, cervix | Normal |
| D9 | 59 | M | Peripheral nerve | Normal | | H9 | 44 | F | Uterus, cervix | Normal |
| | | | | | | H10 | 38 | F | Uterus, endometrium | Normal |
| D10 | 44 | F | Peripheral nerve | Schwannoma | | H11 | 41 | F | Uterus, endometrium | Normal |
| D11 | 44 | F | Ureter | Normal | | H12 | 46 | F | Uterus, endometrium | Normal |
| D12 | 42 | F | Ureter | Normal | | H13 | 58 | M | Skin | Malignant melanoma (tissue marker) |
| D13 | 57 | F | Liver | Normal | | | | | | |

Figure 179A-179C

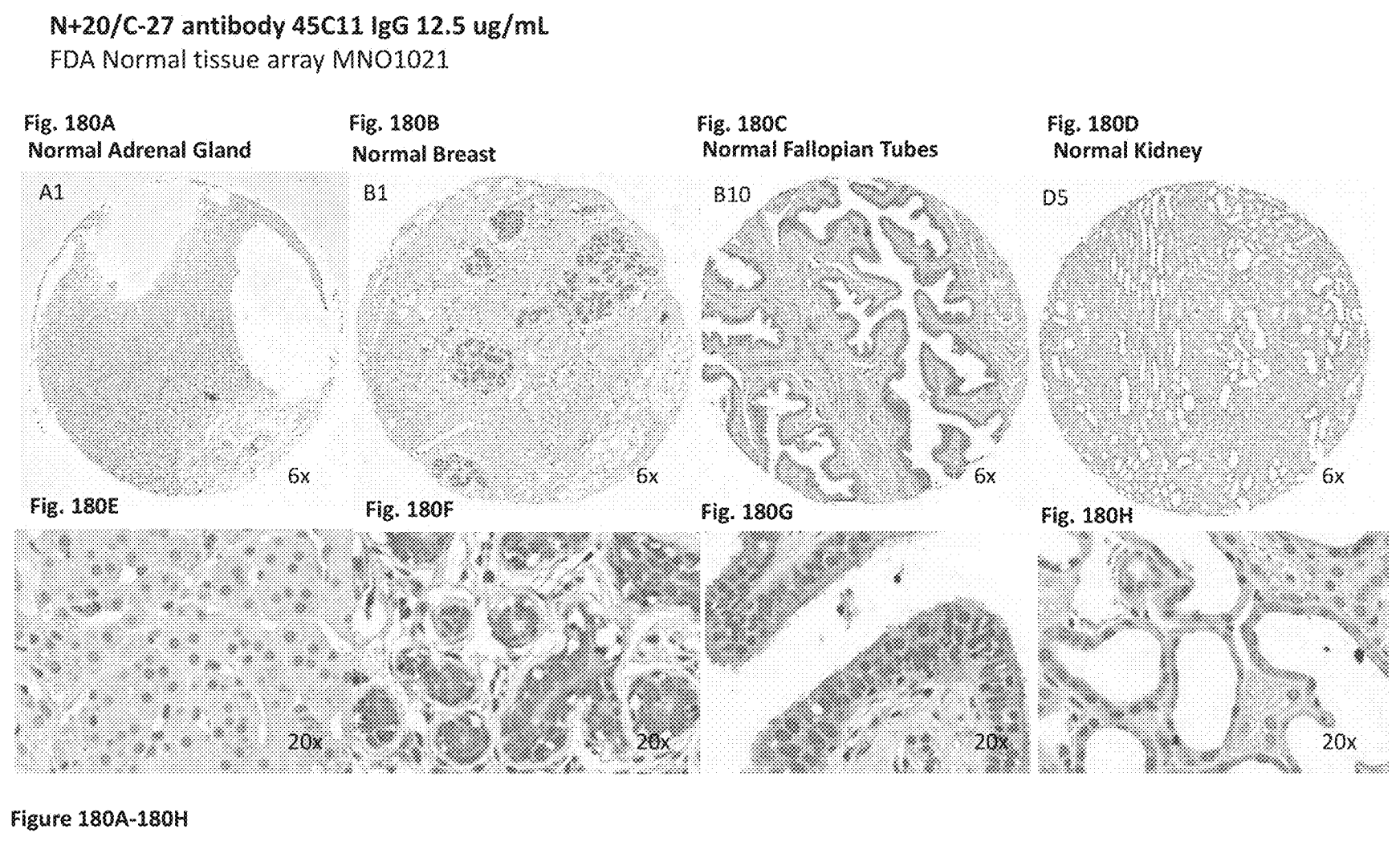

N+20/C-27 antibody 45C11 IgG 12.5 ug/mL
FDA Normal tissue array MNO1021

Fig. 180A          Fig. 180B          Fig. 180C          Fig. 180D
Normal Adrenal Gland   Normal Breast   Normal Fallopian Tubes   Normal Kidney Fig. 180E          Fig. 180F          Fig. 180G          Fig. 180H

Figure 180A-180H

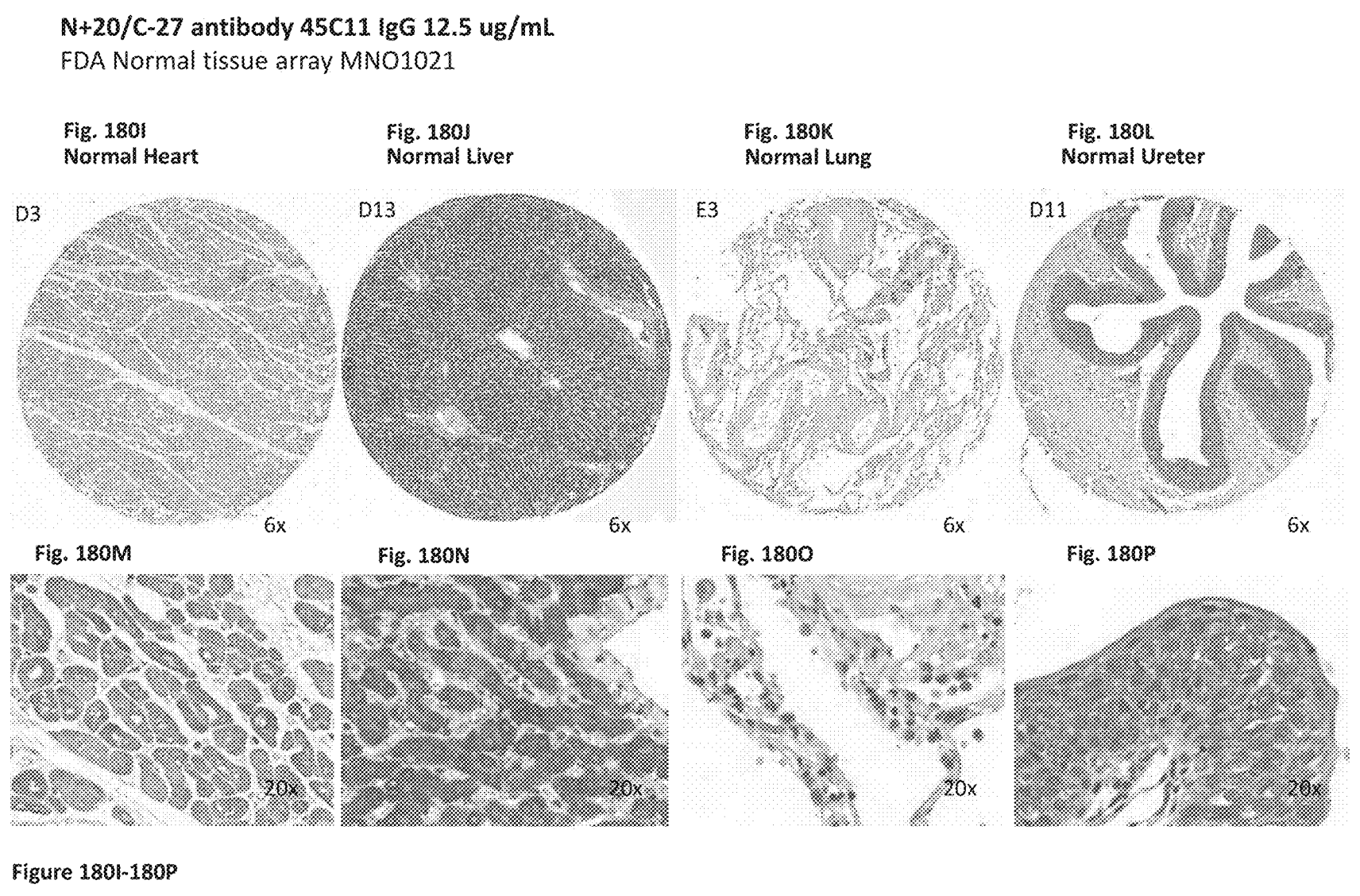

N+20/C-27 antibody 45C11 IgG 12.5 ug/mL
FDA Normal tissue array MNO1021

Fig. 180I
Normal Heart

Fig. 180J
Normal Liver

Fig. 180K
Normal Lung

Fig. 180L
Normal Ureter

N+20/C-27 antibody 45C11 IgG 12.5 ug/mL
FDA Normal tissue array MNO1021

Normal eye

Normal Cerebral cortex

Normal Bone marrow

Normal Skeletal muscle

N+20/C-27 antibody 45C11 IgG 10 ug/mL
Breast cancer tissue array BR1007

N+20/C-27 antibody 45C11 IgG   10 ug/mL.
Breast cancer tissue array BR1007

Position: B4
Cell Type: Invasive Ductal Carcinoma
Tumor Grade: 2
TNM: T1N1M0

Position: B5
Cell Type: Invasive Ductal Carcinoma
Tumor Grade: 2
TNM: T2N2M0

Position: D5
Cell Type: Invasive Ductal Carcinoma
Tumor Grade: 2
TNM: T2N0M0

N+20/C-27 antibody 45C11 5-15 ug/mL
Pancreatic cancer tissue array PA1003

N+20/C-27 antibody 45C11 12.5 ug/mL
Pancreatic cancer tissue array PA805c

Position: F6
Cell Type: Invasive ductal carcinoma
Tumor Grade: 2
TNM: T3N1M0

Position: H8
Cell Type: Invasive ductal carcinoma
Tumor Grade: 2
TNM: T2N2M0

Position: I9
Cell Type: Invasive ductal carcinoma
Tumor Grade: 3
TNM: T2N1M0

N+9/C-9 antibody 3C5 IgG 10 ug/mL
FDA Normal tissue array MNO1021

| Position | Age | Sex | Organ/Anatomic Site | Pathology diagnosis | | Position | Age | Sex | Organ/Anatomic Site | Pathology diagnosis |
|---|---|---|---|---|---|---|---|---|---|---|
| A1 | 31 | F | Adrenal gland | Normal | | E1 | 59 | M | Liver | Normal |
| A2 | 51 | M | Adrenal gland | Normal | | E2 | 27 | F | Liver | Normal |
| A3 | 63 | M | Adrenal gland | Normal | | E3 | 72 | M | Lung | Normal |
| A4 | 75 | M | Bladder, urinary | Normal | | E4 | 55 | M | Lung | Normal |
| A5 | 72 | M | Bladder, urinary | Normal | | E5 | 43 | M | Lung | Normal |
| A6 | 52 | M | Bladder, urinary | Normal | | E6 | 47 | F | Ovary | Normal |
| A7 | 53 | M | Bone, bone marrow | Normal | | E7 | 46 | F | Ovary | Normal |
| A8 | 43 | M | Bone, bone marrow | Normal | | E8 | 40 | F | Ovary | Normal |
| A9 | 44 | F | Head and neck, salivary gland | Normal | | E9 | 42 | F | Pancreas | Normal |
| A10 | 19 | M | Head and neck, salivary gland | Normal | | E10 | 28 | M | Pancreas | Normal |
| A11 | 55 | M | Eye | Normal | | E11 | 59 | M | Pancreas | Normal |
| A12 | 60 | M | Eye | Normal | | E12 | 17 | M | Parathyroid | Adenoma |
| A13 | 35 | F | Breast | Normal | | E13 | 72 | F | Parathyroid | Adenoma |
| B1 | 38 | F | Breast | Normal | | F1 | 3 | F | Pituitary gland | Normal |
| B2 | 33 | F | Breast | Normal | | F2 | 32 | M | Pituitary gland | Normal |
| B3 | 58 | M | Brain, cerebellum | Normal | | F3 | 30 | F | Placenta | Normal |
| B4 | 65 | M | Brain, cerebellum | Normal | | F4 | 27 | F | Placenta | Normal |
| B5 | | | Brain, cerebellum | Normal | | F5 | | F | Placenta | Normal |
| B6 | 59 | M | Brain, cerebral cortex | Normal | | F6 | 64 | M | Prostate | Normal |
| B7 | 65 | M | Brain, cerebral cortex | Normal | | F7 | 65 | M | Prostate | Normal |
| B8 | | | Brain, cerebral cortex | Normal | | F8 | 65 | M | Prostate | Normal |
| B9 | 42 | F | Fallopian tube | Normal | | F9 | 32 | M | Skin | Normal |
| B10 | 32 | F | Fallopian tube | Normal | | F10 | 68 | M | Skin | Normal |
| B11 | 24 | F | Fallopian tube | Normal | | F11 | 29 | M | Skin | Normal |
| B12 | 45 | M | Esophagus | Normal | | F12 | 47 | M | Spinal cord | Normal |
| B13 | 68 | F | Esophagus | Normal | | F13 | 58 | M | Spinal cord | Normal |
| C1 | 54 | M | Esophagus | Normal | | G1 | 27 | M | Spleen | Normal |
| C2 | 45 | M | Stomach | Normal | | G2 | 60 | M | Spleen | Normal |
| C3 | 49 | M | Stomach | Normal | | G3 | 31 | M | Spleen | Normal |
| C4 | 77 | M | Stomach | Normal | | G4 | 60 | M | Skeletal muscle | Normal |
| C5 | 45 | M | Intestine, small intestine | Normal | | G5 | 49 | F | Skeletal muscle | Normal |
| C6 | 47 | F | Intestine, small intestine | Normal | | G6 | 70 | M | Skeletal muscle | Normal |
| C7 | 75 | F | Intestine, small intestine | Normal | | G7 | 43 | M | Testis | Normal |
| C8 | 2 | M | Intestine, colon | Normal | | G8 | 30 | M | Testis | Normal |
| C9 | 46 | M | Intestine, colon | Normal | | G9 | 77 | M | Testis | Normal |
| C10 | 74 | M | Intestine, colon | Normal | | G10 | 15 | M | Thymus | Normal |
| C11 | 47 | F | Intestine, rectum | Normal | | G11 | 28 | M | Thymus | Normal |
| C12 | 75 | F | Intestine, rectum | Normal | | G12 | 9 | F | Thymus | Normal |
| C13 | 66 | M | Intestine, rectum | Normal | | G13 | , | | | , |
| D1 | 38 | M | Heart | Normal | | H1 | 28 | M | Thyroid | Normal |
| D2 | 46 | M | Heart | Normal | | H2 | 27 | F | Thyroid | Normal |
| D3 | 34 | M | Heart | Normal | | H3 | 51 | F | Thyroid | Normal |
| D4 | 52 | M | Kidney, cortex | Normal | | H4 | 46 | M | Tonsil | Normal |
| D5 | 23 | M | Kidney, cortex | Normal | | H5 | 37 | M | Tonsil | Normal |
| D6 | 63 | M | Kidney, cortex | Normal | | H6 | 13 | M | Tonsil | Normal |
| D7 | 52 | M | Kidney, medulla | Normal | | H7 | 38 | F | Uterus, cervix | Normal |
| D8 | 23 | M | Kidney, medulla | Normal | | H8 | 35 | F | Uterus, cervix | Normal |
| D9 | 59 | M | Peripheral nerve | Schwannoma | | H9 | 44 | F | Uterus, cervix | Normal |
| D10 | 29 | F | Peripheral nerve | Schwannoma | | H10 | | | Uterus, endometrium | Normal |
| D11 | 44 | F | Ureter | Normal | | H11 | 41 | F | Uterus, endometrium | Normal |
| D12 | 42 | F | Ureter | Normal | | H12 | 46 | F | Uterus, endometrium | Normal |
| D13 | 57 | F | Liver | Normal | | H13 | 58 | M | Skin | Malignant melanoma (tissue marker) |

Figure 185A-185C

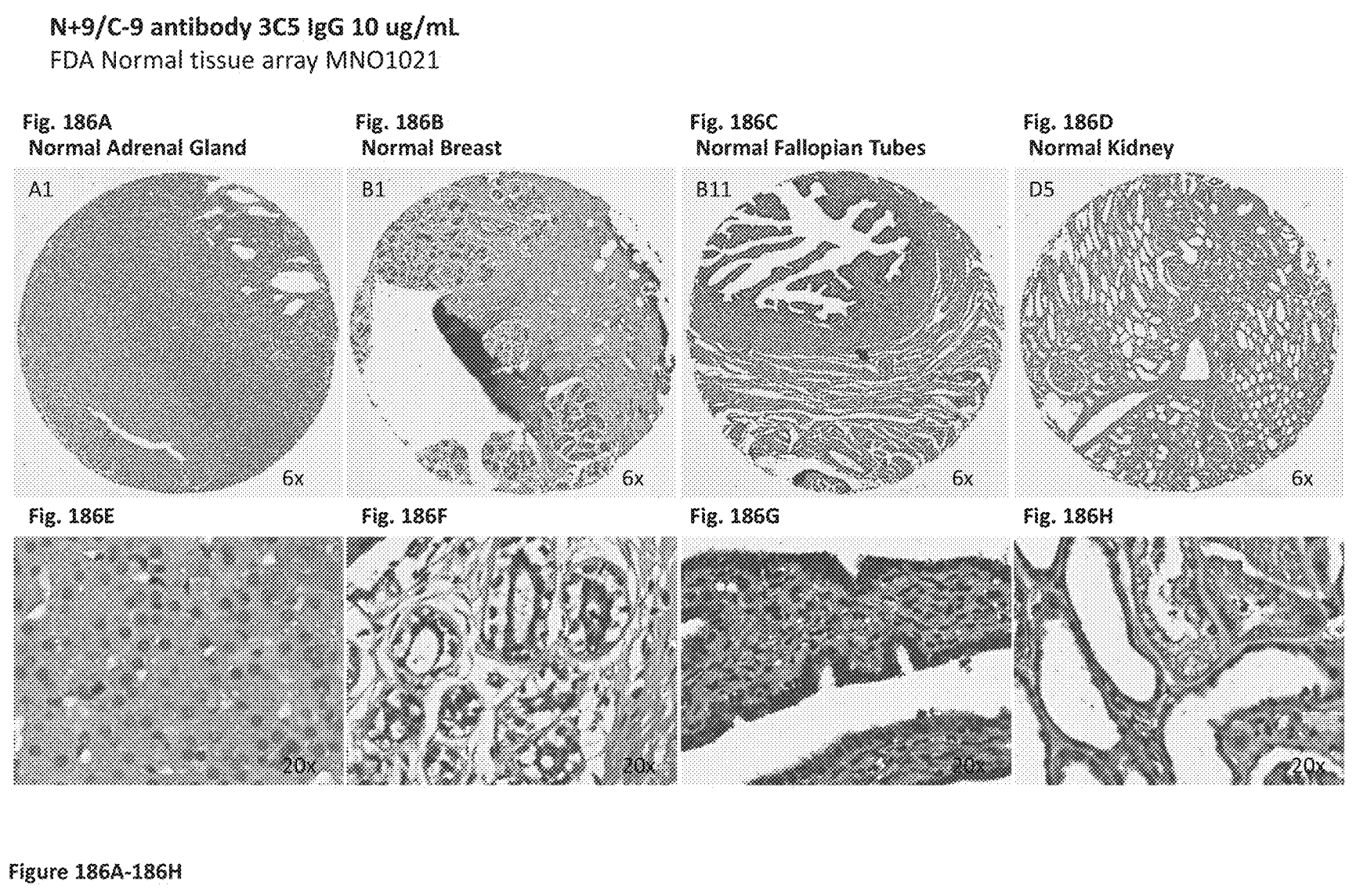

N+9/C-9 antibody 3C5 IgG 10 ug/mL
FDA Normal tissue array MNO1021

Fig. 186A
Normal Adrenal Gland

Fig. 186B
Normal Breast

Fig. 186C
Normal Fallopian Tubes

Fig. 186D
Normal Kidney

N+9/C-9 antibody 3C5 IgG 10 ug/mL
FDA Normal tissue array MNO1021

Normal Heart

Normal Liver

Normal Lung

Normal Ureter

N+9/C-9 antibody 3C5 IgG 10 ug/mL
FDA Normal tissue array MNO1021

Normal Eye

Normal Cerebral Cortex

Normal Bone Marrow

Normal Skeletal Muscle

N+9/C-9 antibody 3C5  10 ug/mL
Pancreatic cancer tissue array PA1003

N+9/C-9 antibody 3C5  10 ug/mL
Pancreatic cancer tissue array PA1003

Position: C3
Cell Type: Adenocarcinoma
Tumor Grade: 2
TNM: T3N0M0

Position: C4
Cell Type: Adenocarcinoma
Tumor Grade: 2
TNM: T3N0M0

Position: E2
Cell Type: Adenocarcinoma
Tumor Grade: 2-3
TNM: T3N1M0

N+9/C-9 antibody 8A9 IgG 15 ug/mL
FDA Normal tissue array MNO1021

| Position | Age | Sex | Organ/Anatomic Site | Pathology diagnosis | Position | Age | Sex | Organ/Anatomic Site | Pathology diagnosis |
|---|---|---|---|---|---|---|---|---|---|
| A1 | 31 | F | Adrenal gland | Normal | E1 | 59 | M | Liver | Normal |
| A2 | 51 | M | Adrenal gland | Normal | E2 | 27 | F | Liver | Normal |
| A3 | 63 | M | Adrenal gland | Normal | E3 | 72 | M | Lung | Normal |
| A4 | 75 | M | Bladder, urinary | Normal | E4 | 55 | M | Lung | Normal |
| A5 | 72 | M | Bladder, urinary | Normal | E5 | 43 | F | Lung | Normal |
| A6 | 52 | M | Bladder, urinary | Normal | E6 | 47 | F | Ovary | Normal |
| A7 | 53 | M | Bone, bone marrow | Normal | E7 | 46 | F | Ovary | Normal |
| A8 | 43 | M | Bone, bone marrow | Normal | E8 | 40 | F | Ovary | Normal |
| A9 | 44 | F | Head and neck, salivary gland | Normal | E9 | 42 | F | Pancreas | Normal |
| A10 | 19 | M | Head and neck, salivary gland | Normal | E10 | 28 | M | Pancreas | Normal |
| A11 | 55 | M | Eye | Normal | E11 | 59 | F | Pancreas | Normal |
| A12 | 60 | M | Eye | Normal | E12 | 17 | M | Parathyroid | Adenoma |
| A13 | 35 | F | Breast | Normal | E13 | 72 | F | Parathyroid | Adenoma |
| B1 | 38 | F | Breast | Normal | F1 | 3 | F | Pituitary gland | Normal |
| B2 | 33 | F | Breast | Normal | F2 | 32 | F | Pituitary gland | Normal |
| B3 | 58 | M | Brain, cerebellum | Normal | F3 | 30 | F | Placenta | Normal |
| B4 | 65 | M | Brain, cerebellum | Normal | F4 | 27 | F | Placenta | Normal |
| B5 | | | Brain, cerebellum | Normal | F5 | | | Placenta | Normal |
| B6 | 59 | M | Brain, cerebral cortex | Normal | F6 | 64 | M | Prostate | Normal |
| B7 | 65 | M | Brain, cerebral cortex | Normal | F7 | 65 | M | Prostate | Normal |
| B8 | | | Brain, cerebral cortex | Normal | F8 | | M | Prostate | Normal |
| B9 | 42 | F | Fallopian tube | Normal | F9 | 32 | M | Skin | Normal |
| B10 | 32 | F | Fallopian tube | Normal | F10 | | F | Skin | Normal |
| B11 | 24 | F | Fallopian tube | Normal | F11 | 29 | M | Skin | Normal |
| B12 | 45 | M | Esophagus | Normal | F12 | 47 | M | Spinal cord | Normal |
| B13 | 68 | F | Esophagus | Normal | F13 | 58 | M | Spinal cord | Normal |
| C1 | 54 | M | Esophagus | Normal | G1 | 27 | M | Spleen | Normal |
| C2 | 45 | M | Stomach | Normal | G2 | 60 | M | Spleen | Normal |
| C3 | 49 | M | Stomach | Normal | G3 | 31 | M | Spleen | Normal |
| C4 | 77 | M | Stomach | Normal | G4 | 60 | M | Skeletal muscle | Normal |
| C5 | 45 | M | Intestine, small intestine | Normal | G5 | 49 | F | Skeletal muscle | Normal |
| C6 | 33 | M | Intestine, small intestine | Normal | G6 | 70 | M | Skeletal muscle | Normal |
| C7 | 75 | M | Intestine, small intestine | Normal | G7 | 43 | M | Testis | Normal |
| C8 | 2 | M | Intestine, colon | Normal | G8 | 30 | M | Testis | Normal |
| C9 | 46 | M | Intestine, colon | Normal | G9 | 77 | M | Testis | Normal |
| C10 | 74 | M | Intestine, colon | Normal | G10 | 15 | M | Thymus | Normal |
| C11 | 47 | F | Intestine, rectum | Normal | G11 | 28 | M | Thymus | Normal |
| C12 | 75 | F | Intestine, rectum | Normal | G12 | 9 | F | Thymus | Normal |
| C13 | 66 | M | Intestine, rectum | Normal | G13 | | | Thyroid | Normal |
| D1 | 38 | M | Heart | Normal | H1 | 28 | M | Thyroid | Normal |
| D2 | 46 | M | Heart | Normal | H2 | 37 | F | Thyroid | Normal |
| D3 | 34 | M | Heart | Normal | H3 | 51 | M | Thyroid | Normal |
| D4 | 52 | M | Kidney, cortex | Normal | H4 | 46 | M | Tonsil | Normal |
| D5 | 23 | M | Kidney, cortex | Normal | H5 | 37 | M | Tonsil | Normal |
| D6 | 63 | M | Kidney, cortex | Normal | H6 | 13 | M | Tonsil | Normal |
| D7 | 52 | M | Kidney, medulla | Normal | H7 | 38 | F | Uterus, cervix | Normal |
| D8 | 23 | M | Kidney, medulla | Normal | H8 | 35 | F | Uterus, cervix | Normal |
| D9 | 59 | M | Peripheral nerve | Normal | H9 | 44 | F | Uterus, cervix | Normal |
| D10 | 29 | F | Peripheral nerve | Schwannoma | H10 | 38 | F | Uterus, endometrium | Normal |
| D11 | 44 | F | Ureter | Normal | H11 | 41 | F | Uterus, endometrium | Normal |
| D12 | 42 | F | Ureter | Normal | H12 | 46 | F | Uterus, endometrium | Normal |
| D13 | 57 | F | Liver | Normal | H13 | 58 | M | Skin | Malignant melanoma (tissue marker) |

Figure 189A-189C

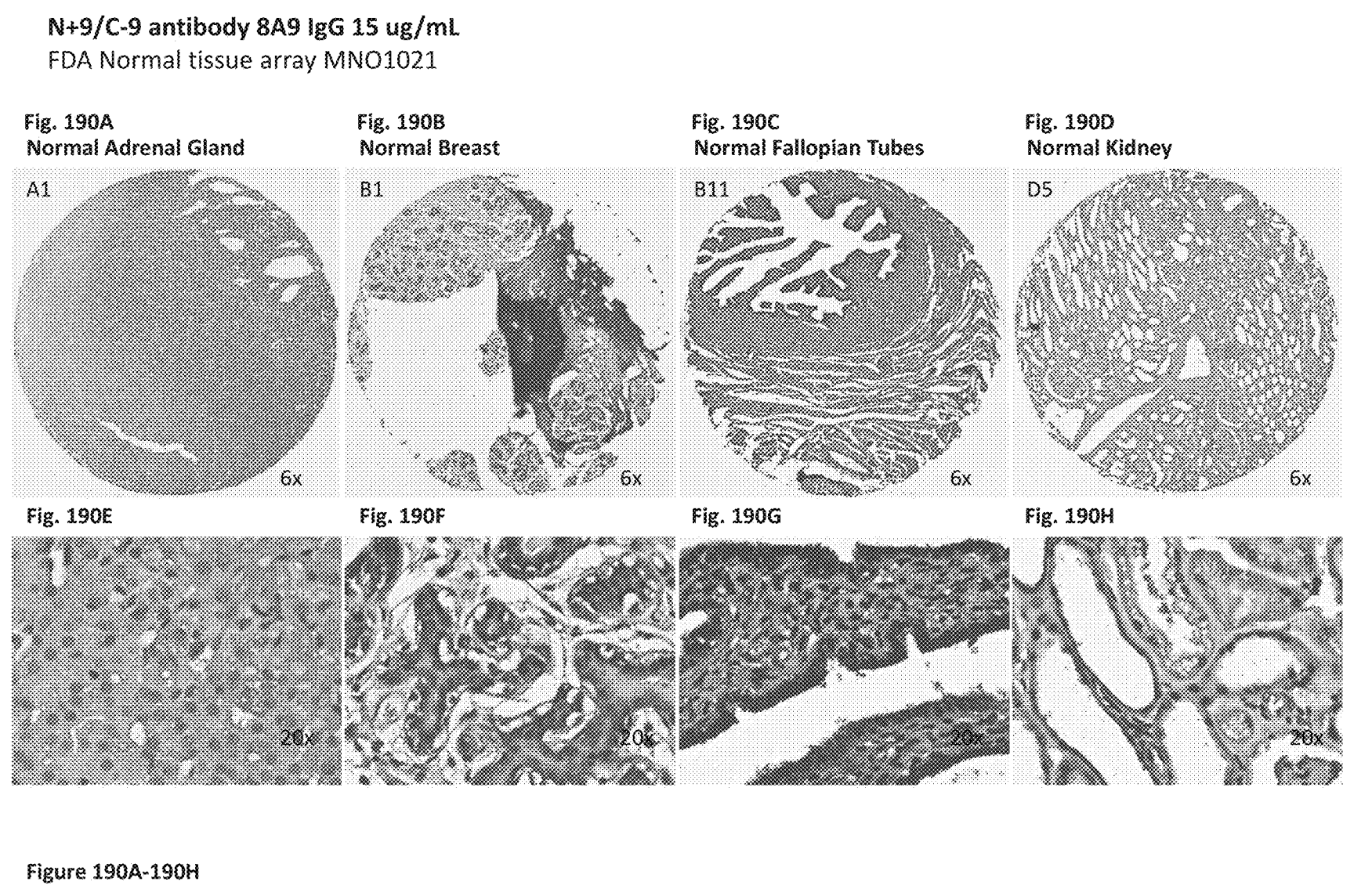

N+9/C-9 antibody 8A9 IgG 15 ug/mL
FDA Normal tissue array MNO1021

Fig. 190A
Normal Adrenal Gland

Fig. 190B
Normal Breast

Fig. 190C
Normal Fallopian Tubes

Fig. 190D
Normal Kidney

N+9/C-9 antibody 8A9 IgG 15 ug/mL
FDA Normal tissue array MNO1021

Fig. 190I
Normal Heart

Fig. 190J
Normal Liver

Fig. 190K
Normal Lung

Fig. 190L
Normal Ureter

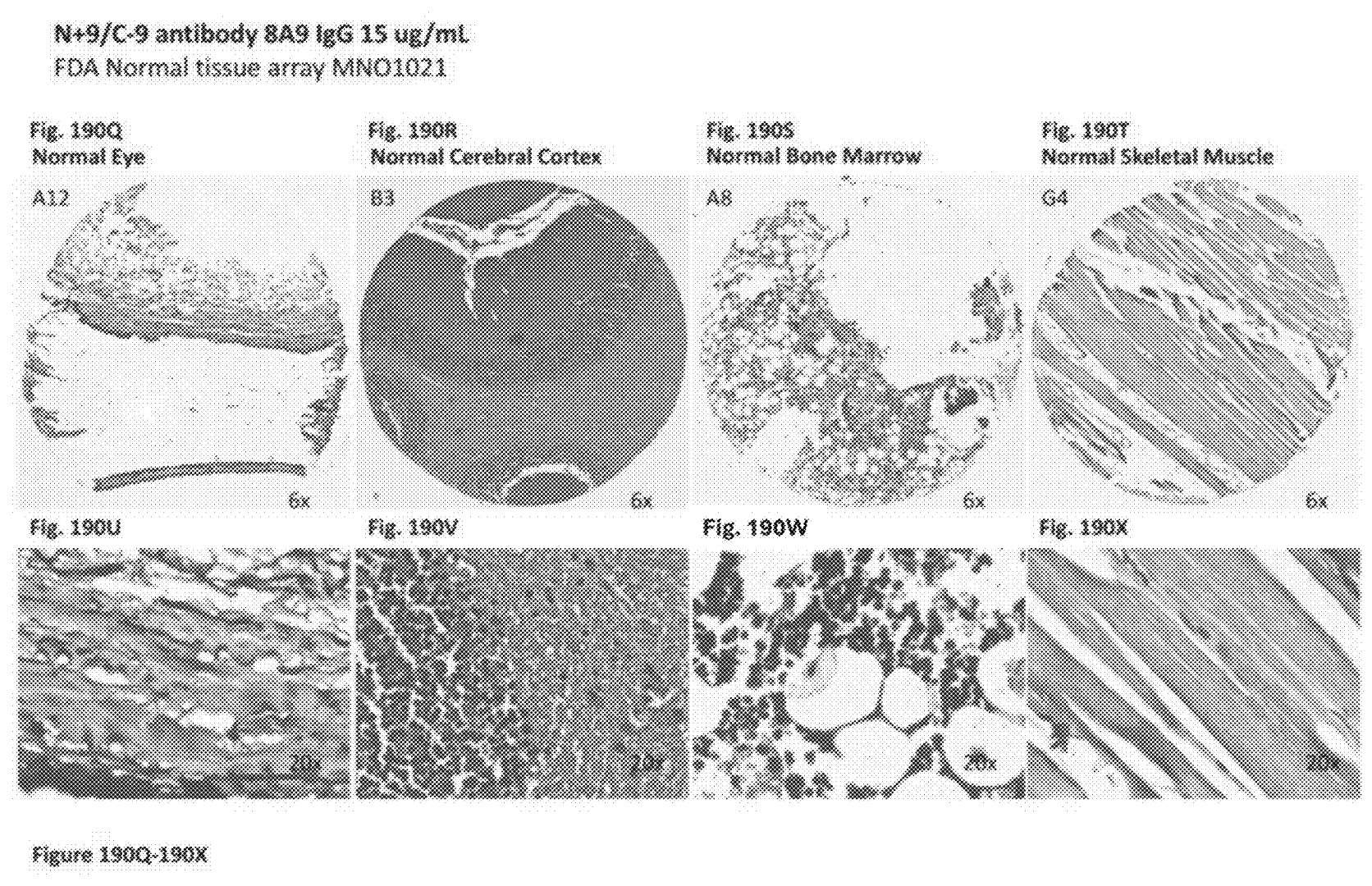

N+9/C-9 antibody 8A9 IgG 15 ug/mL
FDA Normal tissue array MNO1021

Fig. 190Q
Normal Eye
A12

Fig. 190R
Normal Cerebral Cortex
B3

Fig. 190S
Normal Bone Marrow
A8

Fig. 190T
Normal Skeletal Muscle
G4

N+9/C-9 antibody 8A9  15 ug/mL
Pancreatic cancer tissue array PA1003

N+9/C-9 antibody 8A9 15 ug/mL
Pancreatic cancer tissue array PA1003

Position: A1
Cell Type: Adenocarcinoma
Tumor Grade: 2
TNM: T3N0M0

Position: B3
Cell Type: Adenocarcinoma
Tumor Grade: 2
TNM: T3N0M0

Position: C4
Cell Type: Adenocarcinoma
Tumor Grade: 2
TNM: T3N0M0

N+9/C-9 antibody 17H6  30 ug/mL
FDA Normal tissue array MNO1021

| Position | Age | Sex | Organ/Anatomic Site | Pathology diagnosis |
|---|---|---|---|---|
| A1 | 31 | F | Adrenal gland | Normal |
| A2 | 51 | M | Adrenal gland | Normal |
| A3 | 53 | M | Adrenal gland | Normal |
| A4 | 75 | M | Bladder, urinary | Normal |
| A5 | 72 | M | Bladder, urinary | Normal |
| A6 | 82 | M | Bone, bone marrow | Normal |
| A7 | 53 | M | Bone, bone marrow | Normal |
| A8 | 43 | M | Bone, bone marrow | Normal |
| A9 | 44 | F | Head and neck, salivary gland | Normal |
| A10 | 18 | M | Head and neck, salivary gland | Normal |
| A11 | 55 | M | Eye | Normal |
| A12 | 50 | M | Eye | Normal |
| A13 | 35 | F | Breast | Normal |
| B1 | 38 | F | Breast | Normal |
| B2 | 33 | F | Breast | Normal |
| B3 | 56 | M | Brain, cerebellum | Normal |
| B4 | 90 | F | Brain, cerebellum | Normal |
| B5 | 65 | M | Brain, cerebellum | Normal |
| B6 | 58 | M | Brain, cerebral cortex | Normal |
| B7 | 65 | M | Brain, cerebral cortex | Normal |
| B8 |  | F | Brain, cerebral cortex | Normal |
| B9 | 42 | F | Fallopian tube | Normal |
| B10 | 32 | F | Fallopian tube | Normal |
| B11 | 24 | F | Fallopian tube | Normal |
| B12 | 45 | M | Esophagus | Normal |
| B13 | 68 | M | Esophagus | Normal |
| C1 | 34 | M | Esophagus | Normal |
| C2 | 45 | M | Stomach | Normal |
| C3 | 49 | M | Stomach | Normal |
| C4 | 77 | M | Stomach | Normal |
| C5 | 45 | M | Intestine, small intestine | Normal |
| C6 | 75 | F | Intestine, small intestine | Normal |
| C7 | 75 | M | Intestine, small intestine | Normal |
| C8 | 2 | M | Intestine, colon | Normal |
| C9 | 46 | M | Intestine, colon | Normal |
| C10 | 74 | M | Intestine, colon | Normal |
| C11 | 47 | F | Intestine, rectum | Normal |
| C12 | 75 | F | Intestine, rectum | Normal |
| C13 | 66 | M | Intestine, rectum | Normal |
| D1 | 58 | M | Heart | Normal |
| D2 | 46 | M | Heart | Normal |
| D3 | 34 | M | Heart | Normal |
| D4 | 52 | F | Kidney, cortex | Normal |
| D5 | 23 | M | Kidney, cortex | Normal |
| D6 | 63 | M | Kidney, cortex | Normal |
| D7 | 52 | F | Kidney, medulla | Normal |
| D8 | 23 | M | Kidney, medulla | Normal |
| D9 | 59 | M | Peripheral nerve | Normal |
| D10 | 29 | F | Peripheral nerve | Schwannoma |
| D11 | 44 | F | Ureter | Normal |
| D12 | 42 | F | Ureter | Normal |
| D13 | 57 | F | Liver | Normal |

| Position | Age | Sex | Organ/Anatomic Site | Pathology diagnosis |
|---|---|---|---|---|
| E1 | 59 | M | Liver | Normal |
| E2 | 27 | F | Liver | Normal |
| E3 | 72 | M | Lung | Normal |
| E4 | 55 | M | Lung | Normal |
| E5 | 45 | M | Lung | Normal |
| E6 | 47 | F | Ovary | Normal |
| E7 | 46 | F | Ovary | Normal |
| E8 | 40 | F | Ovary | Normal |
| E9 | 42 | M | Pancreas | Normal |
| E10 | 26 | F | Pancreas | Normal |
| E11 | 59 | F | Pancreas | Normal |
| E12 | 17 | M | Parathyroid | Normal |
| E13 | 72 | F | Parathyroid | Adenoma |
| F1 | 3 | F | Pituitary gland | Adenoma |
| F2 |  | F | Pituitary gland | Normal |
| F3 | 32 | F | Placenta | Normal |
| F4 | 30 | F | Placenta | Normal |
| F5 | 27 | F | Placenta | Normal |
| F6 | 84 | M | Prostate | Normal |
| F7 | 84 | M | Prostate | Normal |
| F8 | 65 | M | Prostate | Normal |
| F9 | 32 | F | Skin | Normal |
| F10 | 68 | F | Skin | Normal |
| F11 | 28 | M | Skin | Normal |
| F12 | 47 | M | Spinal cord | Normal |
| F13 | 38 | M | Spinal cord | Normal |
| G1 | 43 | M | Spleen | Normal |
| G2 | 60 | M | Spleen | Normal |
| G3 | 31 | M | Spleen | Normal |
| G4 | 60 | F | Skeletal muscle | Normal |
| G5 | 49 | M | Skeletal muscle | Normal |
| G6 | 70 | M | Skeletal muscle | Normal |
| G7 | 43 | M | Testis | Normal |
| G8 | 30 | M | Testis | Normal |
| G9 | 77 | M | Testis | Normal |
| G10 | 16 | M | Thymus | Normal |
| G11 | 28 | M | Thymus | Normal |
| G12 | 9 | F | Thymus | Normal |
| G13 |  |  | . | . |
| H1 | 26 | F | Thyroid | Normal |
| H2 | 37 | F | Thyroid | Normal |
| H3 | 51 | F | Thyroid | Normal |
| H4 | 46 | M | Tonsil | Normal |
| H5 | 37 | M | Tonsil | Normal |
| H6 | 13 | M | Tonsil | Normal |
| H7 | 38 | F | Uterus, cervix | Normal |
| H8 | 35 | F | Uterus, cervix | Normal |
| H9 | 44 | F | Uterus, cervix | Normal |
| H10 | 35 | F | Uterus, endometrium | Normal |
| H11 | 41 | F | Uterus, endometrium | Normal |
| H12 | 46 | F | Uterus, endometrium | Normal |
| H13 | 58 | M | Skin | Malignant melanoma (tissue marker) |

Figure 193A-193C

N+9/C-9 antibody 17H6  30 ug/mL
FDA Normal tissue array MNO1021

Normal Heart

Normal Liver

Normal Lung

Normal Ureter

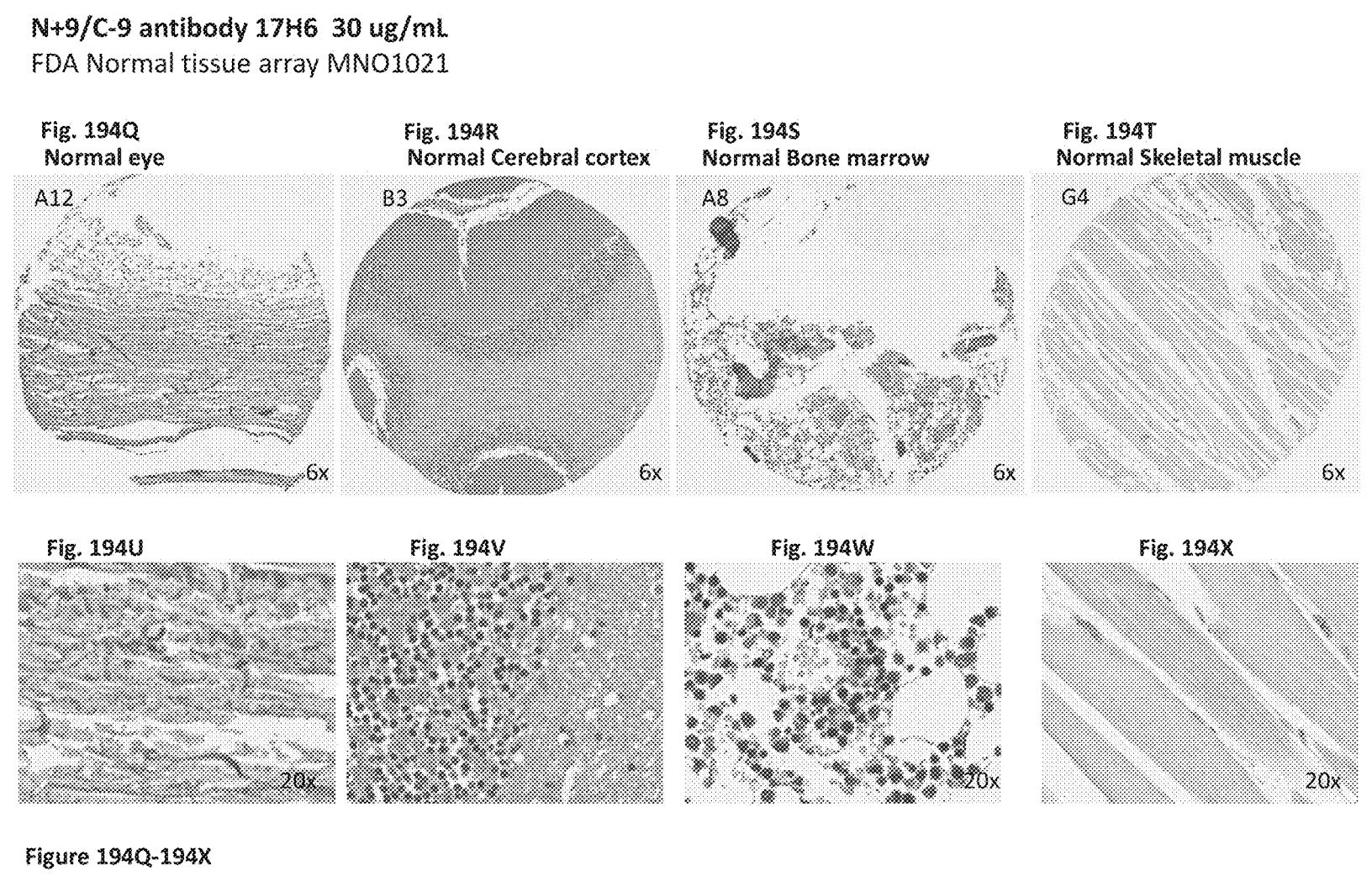

N+9/C-9 antibody 17H6 30 ug/mL
FDA Normal tissue array MNO1021

Fig. 194Q
Normal eye

Fig. 194R
Normal Cerebral cortex

Fig. 194S
Normal Bone marrow

Fig. 194T
Normal Skeletal muscle

N+9/C-9 antibody 17H6 IgG 30 ug/mL
Pancreatic cancer tissue array PA805c

N+9/C-9 antibody 17H6 IgG 30 ug/mL
Pancreatic cancer tissue array PA805c

Position: D7
Cell Type: Papillary Adenocarcinoma
Tumor Grade: 2
TNM: T2N0M0

Position: E5
Cell Type: Ductal Carcinoma
Tumor Grade: 2-3
TNM: T3N1M0

Position: F1
Cell Type: Adenocarcinoma
Tumor Grade: 3
TNM: T3N0M0

N+9/C-9 antibody 39H5 5 ug/mL
FDA Normal tissue array MNO1021

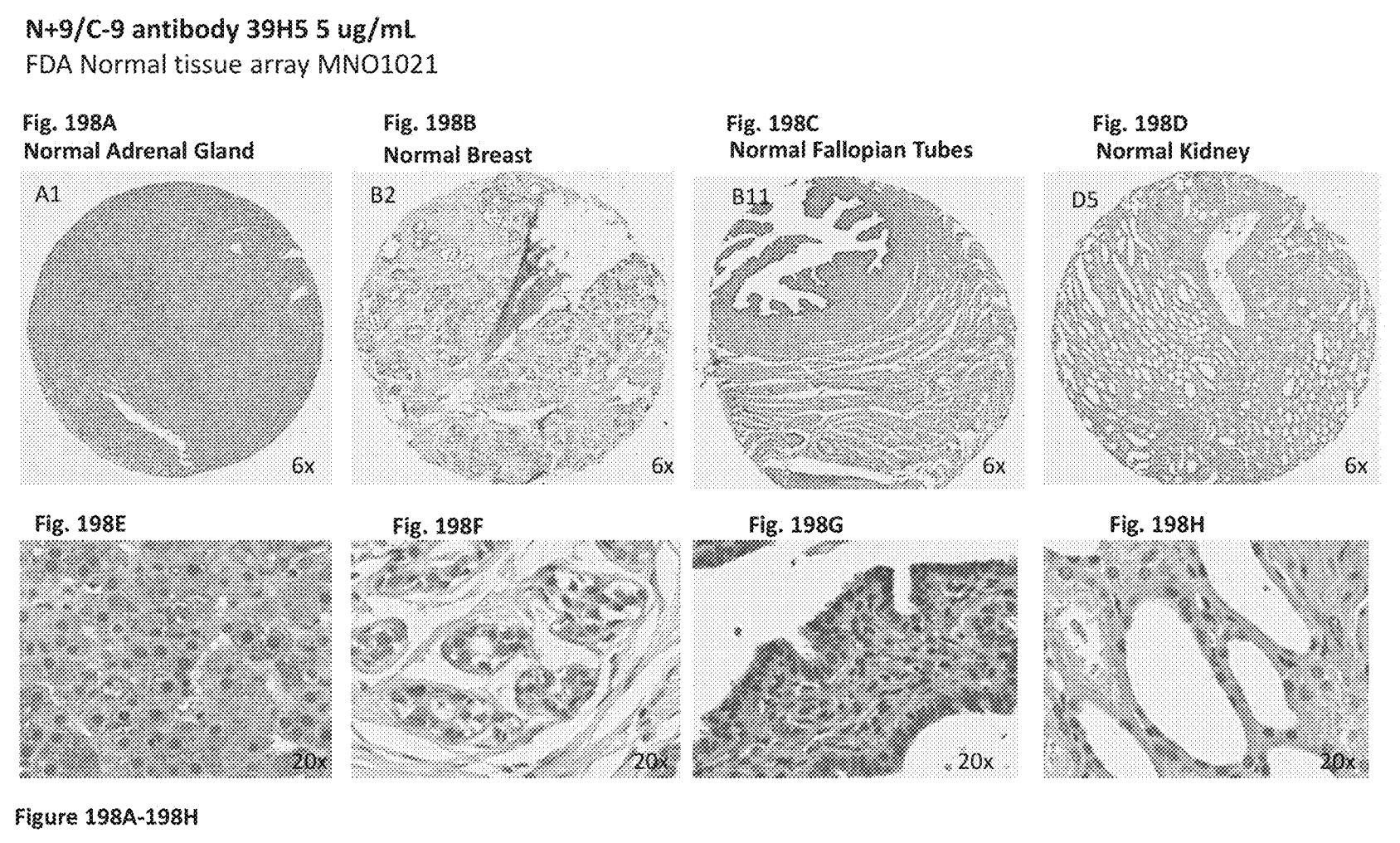

N+9/C-9 antibody 39H5 5 ug/mL
FDA Normal tissue array MNO1021

Fig. 198A
Normal Adrenal Gland

Fig. 198B
Normal Breast

Fig. 198C
Normal Fallopian Tubes

Fig. 198D
Normal Kidney

N+9/C-9 antibody 39H5  5 ug/mL
Pancreatic cancer tissue array PA1003

N+9/C-9 antibody 39H5 5 ug/mL
Pancreatic cancer tissue array PA1003

Fig. 200A     Position: F6
Cell Type: Adenocarcinoma
Tumor Grade: 2
TNM: T3N0M0

Fig. 200B     Position: F7
Cell Type: Adenocarcinoma
Tumor Grade: 2
TNM: T3N0M0

Fig. 200C     Position: G8
Cell Type: Adenocarcinoma
Tumor Grade: 2
TNM: T3N0M0

ELISA – binding of antibodies raised against PSMGFR

Fig. 201A — Binding to PSMGFR

Fig. 201B — Binding to N-10

Fig. 201C — Binding to C-10

Pancreatic Array PA1003:

10 ug/mL 1E4 (N+20/C-27)

10 ug/mL 18B4 (PSMGFR)

1 ug/mL SDIX (PSMGFR)

Pancreatic Array PA1003: Donor E1

10 ug/mL 18B4 (PSMGFR)　　1 ug/mL SDIX (PSMGFR)

8.4x　20x

Pancreatic Array PA1003: Donor C3

10 ug/mL 1E4 (N+20/C-27)

1 ug/mL SDIX (PSMGFR)

8.4x

20x

Pancreatic Array PA1003:

1 ug/mL SDIX (PSMGFR)          0.5 ug/mL 20A10 (PSMGFR)          4 ug/mL 29H1 (N+20/C-27)

**Esophageal Cancer Array ES1001: overview of MUC1* monoclonal staining**
1 ug/mL SDIX (PSMGFR)
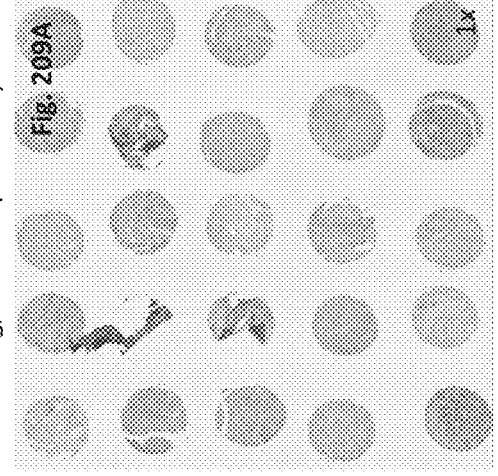
Fig. 209A
0.5 ug/mL 20A10 (PSMGFR)
Fig. 209B
4 ug/mL 29H1 (N+20/C-27)
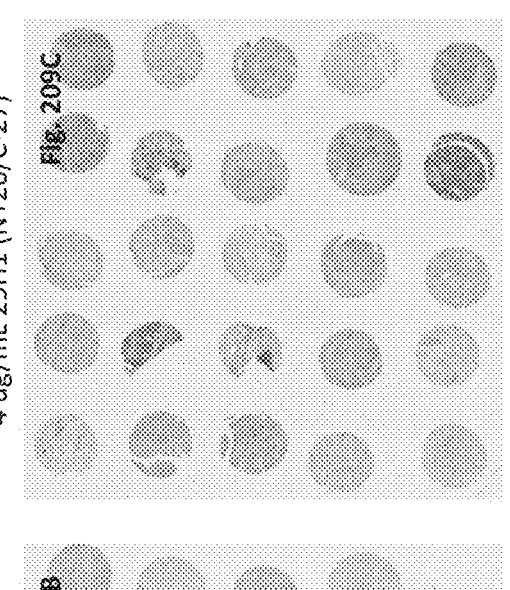
Fig. 209C
5.9 ug/mL 31A1 (N+20/C-27)
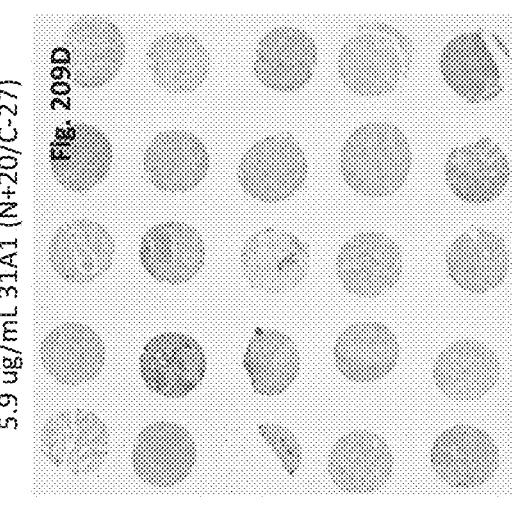
Fig. 209D
Figure 209A-209D Prostate Cancer Array PR1001: overview of MUC1* monoclonal staining 1 ug/mL SDIX (PSMGFR)     0.5 ug/mL 20A10 (PSMGFR)     4 ug/mL 29H1 (N+20/C-27)

huMNC2-CAR44 with NFAT inducible IL-18 for increased persistence

T47D breast cancer cells low – med antigen density; doped with increasing percentages of high antigen density cells IL-18 also increases killing of low antigen density cells in a concentration dependent manner huMNC2-CAR44-IL-18 does not increase killing of normal cells Heavy Chain Consensus Sequences
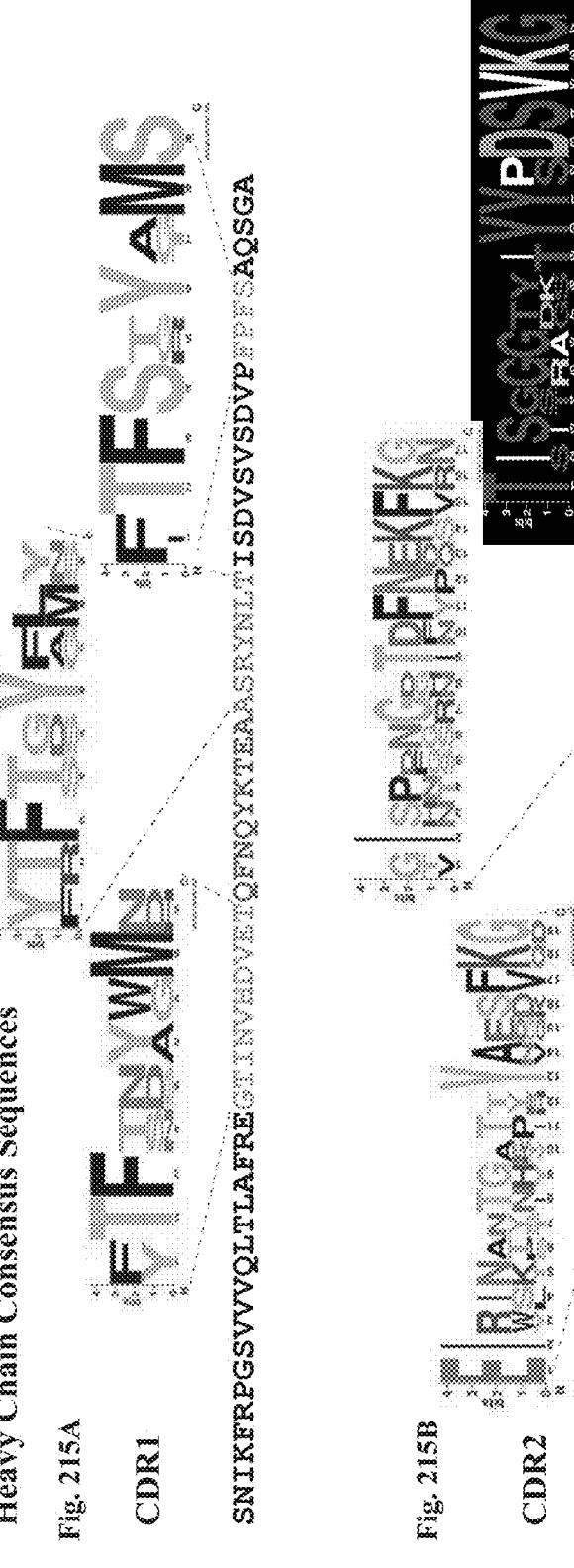
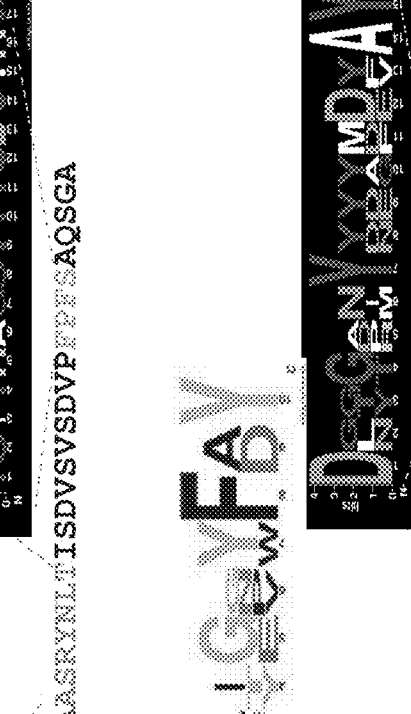
Fig. 215A
CDR1
SNIKFRPGSVVVQLTLAFREGT INVHDVEFQFNQYKTEAASRYNLTISDVSVSDVPFFSAQSGA
Fig. 215B
CDR2
SNIKFRPGSVVVQLTLAFREGT INVHDVEFQFNQYKTEAASRYNLTISDVSVSDVPFFSAQSGA
Fig. 215C
CDR3
SNIKFRPGSVVVQLTLAFREGT INVHDVEFQFNQYKTEAASRYNLTISDVSVSDVPFFSAQSGA
Figure 215A-215C Light Chain Consensus Sequences
Fig. 216A
CDR1
SNIKFRPGSVVVQLTLAFREGTINVHDVETQFNQYKTEAASRYNLTISDVSVSDVPFFAQSGA
Fig. 216B
CDR2
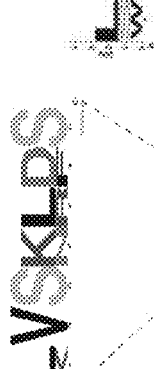
SNIKFRPGSVVVQLTLAFREGTINVHDVETQFNQYKTEAASRYNLTISDVSVSDVPFFAQSGA
Fig. 216C
CDR3
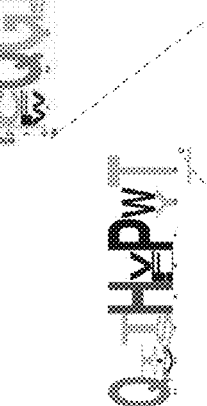
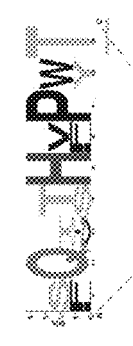
SNIKFRPGSVVVQLTLAFREGTINVHDVETQFNQYKTEAASRYNLTISDVSVSDVPFFAQSGA
Figure 216A-216C

ANTI-VARIABLE MUC1* ANTIBODIES AND USES THEREOF

SEQUENCE LISTING

The instant application contains a Sequence Listing which has been submitted electronically in ASCII format and is hereby incorporated by reference in its entirety. Said ASCII copy, created on Mar. 19, 2024, is named 56699-741_301_SL.txt and is 1,025,433 bytes in size.

BACKGROUND OF THE INVENTION

1. Field of the Invention

The present application relates to human, humanized and non-human anti-MUC1* antibodies and methods of making and using them. The present application also relates to using an immune cell transfected or transduced with a cleavage enzyme for the treatment of cancer. The present invention also relates to using an immune cell transfected or transduced with a CAR and another protein for the treatment of cancer.

2. General Background and State of the Art

We previously discovered that a cleaved form of the MUC1 (SEQ ID NO:1) transmembrane protein is a growth factor receptor that drives the growth of over 75% of all human cancers. The cleaved form of MUC1, which we called MUC1* (pronounced muk 1 star), is a powerful growth factor receptor. Cleavage and release of the bulk of the extracellular domain of MUC1 unmasks a binding site for activating ligands dimeric NME1, NME6, NME7, NME7$_{AB}$, NME7-X1 or NME8. It is an ideal target for cancer drugs as it is aberrantly expressed on over 75% of all cancers and is likely overexpressed on an even higher percentage of metastatic cancers (Mahanta et al. (2008) A Minimal Fragment of MUC1 Mediates Growth of Cancer Cells. PLOS ONE 3 (4): e2054. doi: 10.1371/journal-.pone.0002054; Fessler et al. (2009), "MUC1* is a determinant of trastuzumab (Herceptin) resistance in breast cancer cells," Breast Cancer Res Treat. 118 (1): 113-124). After MUC1 cleavage most of its extracellular domain is shed from the cell surface. The remaining portion has a truncated extracellular domain that comprises most or all of the primary growth factor receptor sequence called PSMGFR (SEQ ID NO: 2).

Antibodies are increasingly used to treat human diseases. Antibodies generated in non-human species have historically been used as therapeutics in humans, such as horse antibodies. More recently, antibodies are engineered or selected so that they contain mostly, or all, human sequences in order to avoid a generalized rejection of the foreign antibody. The process of engineering recognition fragments of a non-human antibody into a human antibody is generally called 'humanizing'. The amount of non-human sequences that are used to replace the human antibody sequences determines whether they are called chimeric, humanized or fully human.

Alternative technologies exist that enable generation of humanized or fully human antibodies. These strategies involve screening libraries of human antibodies or antibody fragments and identifying those that bind to the target antigen, rather than immunizing an animal with the antigen. Another approach is to engineer the variable region(s) of an antibody into an antibody-like molecule. Another approach involves immunizing a humanized animal. The present invention is intended to also encompass these approaches for use with recognition fragments of antibodies that the inventors have determined bind to the extracellular domain of MUC1*.

In addition to treating patients with an antibody, cancer immunotherapies have recently been shown to be effective in the treatment of blood cancers. One cancer immunotherapy, called CAR T (chimeric antigen receptor T cell) therapy, engineers a T cell so that it expresses a chimeric receptor having an extra cellular domain that recognizes a tumor antigen, a transmembrane domain and cytoplasmic tail comprising T cell signaling and co-stimulatory components (Dai H, Wang Y, Lu X, Han W. (2016) Chimeric Antigen Receptors Modified T-Cells for Cancer Therapy. J Natl Cancer Inst. 108 (7): djv439). Such receptor is composed of a single chain antibody fragment (scFv) that recognizes a tumor antigen, linked to a T cell transmembrane, signaling domain and co-stimulatory domain or domains. Upon binding of the receptor to a cancer associated antigen, a signal is transmitted resulting in T-cell activation, propagation and the targeted killing of the cancer cells. In practice, T cells are isolated from a patient or donor and transduced with a CAR, expanded and then injected back into the patient. If from a donor, the immune cells may be mutated or engineered such that they do not induce graft versus host disease in the recipient. When the CAR T cells bind to the antigen on a cancer cell, the CAR T cells attack the cancer cells and then expand that population of T cells.

Thus far, CAR T therapies have been very successful in the treatment of blood cancers but as yet have not shown efficacy against solid tumors in humans. Because most blood cancers are B cell malignancies, the CAR T cells can just eliminate all of the patient's B cells without causing serious harm to the patient. There is no B cell equivalent in solid tumors. Most tumor associated antigens are also expressed on normal tissues; they are just expressed at a higher level in cancerous tissues. Thus, the challenge is to develop an antibody that recognizes an epitope on a tumor associated antigen that is somehow different in the context of the tumor compared to normal tissue. To further minimize the risk of off-tumor/on-target killing of normal tissues, the antibody should recognize and bind to cancerous tissues at least two-times more than normal tissues. Antibodies that are not so cancer selective may be used therapeutically if they are inducibly expressed at the tumor site.

Another cancer therapy that incorporates cancer selective antibodies is Bi-specific T cell Engagers, also called BiTEs™. The BiTE™ approach attempts to eliminate the CAR T associated risk of off-tumor/on-target effects. Unlike CAR T, BiTES™ are bispecific antibodies that should not pose any greater risk than regular antibody-based therapies. However, unlike typical anti-cancer antibodies that bind to and block a cancer antigen, BiTES™ are designed to bind to an antigen on the tumor cell and simultaneously bind to an antigen on an immune cell, such as a T cell. In this way, a BiTE™ recruits the T cell to the tumor. BiTES™ are engineered proteins that simultaneously bind to a cancer associated antigen and a T-cell surface protein such as CD3-epsilon. BiTES™ are antibodies made by genetically linking the scFv's of an antibody that binds to a T cell antigen, like anti-CD3-epsilon to a scFv of a therapeutic monoclonal antibody that binds to a cancer antigen (Patrick A. Baeuerle, and Carsten Reinhardt (2009) Bispecific T-cell engaging antibodies for cancer therapy. Cancer Res. 69 (12):

4941-4944). A drawback of BiTE™ technology is that, unlike CAR T cells, they do not expand in the patient, so have limited persistence.

Yet another cancer therapy that incorporates cancer selective antibodies is antibody drug conjugate, also called ADC, technology. In this case, a toxin, or a precursor to a toxin, is linked to a cancer selective antibody. Unlike CAR T cells that use the CD8 positive T cell's natural killing to kill cancer cells, ADCs carry a toxic payload to the tumor. Drawbacks of ADCs include the potential of delivering the toxic payload to normal cells and that most ADCs require binding to a cell surface molecule which then gets internalized after binding, with an approximate 10,000 surface molecule required for resultant cell death.

SUMMARY OF THE INVENTION

In one aspect, the present invention is directed to a non-human, human or humanized anti-MUC1* antibody or antibody fragment or antibody-like protein that binds to a region on extracellular domain of MUC1 isoform or cleavage product that is devoid of the tandem repeat domains. The non-human, human or humanized anti-MUC1* antibody or antibody fragment or antibody-like protein may specifically bind to (i) PSMGFR region of MUC1;

(ii) PSMGFR peptide;

(iii) a peptide having amino acid sequence of QFNQYK-TEAASRYNLTISDVSVSDVPFPFSAQSGA (N-10) (SEQ ID NO:3)

(iv) a peptide having amino acid sequence of ASRYNLTISDVSVSDVPFPFSAQSGA (N-19) (SEQ ID NO:4)

(v) a peptide having amino acid sequence of NLTISDVSVSDVPFPFSAQSGA (N-23) (SEQ ID NO:5)

(vi) a peptide having amino acid sequence of ISDVSVSDVPFPFSAQSGA (N-26) (SEQ ID NO:6)

(vii) a peptide having amino acid sequence of SVSDVPFPFSAQSGA (N-30) (SEQ ID NO:7)

(viii) a peptide having amino acid sequence of QFNQYKTEAASRYNLTISDVSVSDVPFPFS (N-10/C-5) (SEQ ID NO:8)

(ix) a peptide having amino acid sequence of ASRYNLTISDVSVSDVPFPFS (N-19/C-5) (SEQ ID NO:9)

(x) a peptide having amino acid sequence of FPFSAQSGA (SEQ ID NO:10)

The non-human, human or humanized antibody may be IgG1, IgG2, IgG3, IgG4 or IgM. The human or humanized antibody fragment or antibody-like protein may be scFv or scFv-Fc.

The murine, camelid, human or humanized antibody, antibody fragment or antibody-like protein as in above may comprise a heavy chain variable region and light chain variable region which is derived from mouse monoclonal MNC2, MNE6, 20A10, 3C2B1, 5C6F3, 25E6, 18G12, 28F9, 1E4, B12, B2, B7, B9, 8C7F3, and H11 antibody, and has at least 80%, 90% or 95% or 98% sequence identity to the mouse monoclonal MNC2, MNE6, 20A10, 3C2B1, 5C6F3, 25E6, 18G12, 28F9, 1E4, B12, B2, B7, B9, 8C7F3, and H11 antibody. The heavy chain variable region of CDR1 and CDR2 may have at least 90% or 95% or 98% sequence identity to the particularly indicated antibody heavy chain variable region sequence set forth in the present application in the sequence listing, and the light chain variable region of CDR1 and CDR2 may have at least 90% or 95% or 98% sequence identity to the particularly indicated antibody heavy chain variable region sequence set forth in the present application in the sequence listing section. The heavy chain variable region of CDR3 may have at least 80% or 85% or 90% sequence identity to the particularly indicated antibody heavy chain variable region sequence set forth in the present application in the sequence listing, and the light chain variable region of CDR3 may have at least 80% or 85% or 90% sequence identity to the particularly indicated antibody heavy chain variable region sequence set forth in the present application in the sequence listing section.

The murine, camelid, human or humanized antibody, antibody fragment or antibody-like protein according to above may include complementarity determining regions (CDRs) in the heavy chain variable region and light chain variable region having at least 90% or 95% or 98% sequence identity to the particularly indicated antibody heavy chain CDR1, CDR2 or CDR3 region and light chain CDR1, CDR2 or CDR3 region sequences set forth in the present application in the sequence listing section.

In another aspect, the present invention is directed to an anti-MUC1* extracellular domain antibody or anti-N-10 antibody, which may be any of the antibodies described above, comprised of sequences represented by humanized IgG2 heavy chain, or humanized IgG1 heavy chain, paired with humanized Kappa light chain, or humanized Lambda light chain. The humanized IgG2 heavy chain may be SEQ ID NOS: 53, humanized IgG1 heavy chain may be SEQ ID NO:57, humanized Kappa light chain may be SEQ ID NO:108, and humanized Lambda light chain may be SEQ ID NO:112, or a sequence having 90%, 95% or 98% sequence identity thereof.

In another aspect, the invention is directed to an anti-MUC1* extracellular domain antibody or anti-N-10 antibody comprised of sequences of a humanized MN-C2 represented by humanized IgG1 heavy chain, humanized IgG2 heavy chain, paired with humanized Lambda light chain, and humanized Kappa light chain.

In another aspect, the invention is directed to an anti-MUC1* extracellular domain antibody or anti-N-10 antibody comprised of sequences of a humanized MNC2, MNE6, 20A10, 3C2B1, 5C6F3, 25E6, 18G12, 28F9, 1E4, B12, B2, B7, B9, 8C7F3, or H11 represented by humanized IgG1 heavy chain or humanized IgG2 heavy chain, paired with humanized Lambda light chain, or humanized Kappa light chain.

In another aspect, the invention is directed to an antibody that is "like" MNC2, MNE6, 20A10, 3C2B1, 5C6F3, 25E6, 18G12, 28F9, 1E4, B12, B2, B7, B9, 8C7F3, or H11 in that they have the same or very similar pattern of binding to subsets of peptides derived from the PSMGFR peptide, also do not recognize a linear epitope, competitively inhibit the binding of NME1 or $NME7_{AB}$ to MUC1*, recognize a MUC1 transmembrane cleavage product produced by cleavage by MMP9 or contain CDR sequences that are at least 80% homologous to the MN-E6, MN-C2, MN-18G12, MN-20A10, MN-25E6, MN-28F9, MN-5C6F3, MN-3C2B1, and MN-1E4 CDR consensus sequences.

In another aspect, the invention is directed to an antibody that binds to the extra cellular domain of a MUC1 that is devoid of the tandem repeat domain, which may be a cleavage product. In one aspect of the invention, the antibody binds to a peptide having the sequence of QFNQYK-TEAASRYNLTISDVSVSDVPFPFSAQSGA (SEQ ID NO: 3) (N-10). In one aspect of the invention, the antibody binds to a peptide having the sequence of ASRYNLTISDVSVSDVPFPFSAQSGA (SEQ ID NO: 4) (N-19). In one aspect of the invention, the antibody binds to a peptide having the sequence of SVSDVPFPFSAQSGA (SEQ ID NO: 7) (N-30). In one aspect of the invention, the antibody binds to a peptide having the sequence of FPFSAQSGA (SEQ ID NO: 10) (N-36). Examples of such antibodies include but are not limited to monoclonal antibodies MNC2, MNE6, 20A10, 3C2B1, 5C6F3, 25E6, 18G12, 28F9, 1E4, B12, B2, B7, B9, 8C7F3, and H11. The heavy chain and light chain complementary determining region sequences for these antibodies are set forth in the present application in the sequence listing section.

In one aspect of the invention, one or more of these antibodies is administered to a patient diagnosed with or at risk of developing a cancer. The antibody may be human or humanized. The antibody may be murine or camelid. The antibody may be bivalent or monovalent. The antibody may be a fragment, including a single chain fragment, scFv, of one of the antibodies. The antibody or antibody fragment may be administered directly to the patient or incorporated into a bispecific antibody, a bispecific T cell engager, BiTE, or an antibody drug conjugate, ADC. The antibody or antibody fragment may be incorporated into a T cell receptor, TCR. The sequence of the antibody or antibody fragment may be incorporated into a chimeric antigen receptor, a "CAR", or other similar entity, then introduced into an immune cell, ex vivo, then administered to a patient diagnosed with or at risk of developing a cancer. The immune cell, which may be a T cell or natural killer cell, may be derived from a donor or from the patient. In one aspect the immune cell is derived from a stem cell that has been directed to differentiate to that immune cell type in vitro. In one aspect, the antibody or a CAR containing sequences of the antibody may be expressed off of an inducible promoter. In one case the antibody or the CAR is expressed upon activation of the T cell or other immune cell. In one instance, the antibody or the CAR of the invention is expressed off of an NFAT response element. In another instance, CAR recognition of a target tumor cell activates the immune cell, leading to NFAT inducible expression of a cytokine, such as IL-12 or IL-18, or expression of a checkpoint inhibitor such as a PD1 inhibitor or a PDL-1 inhibitor. In yet another aspect, CAR recognition of a target tumor cell activates the immune cell, leading to NFAT inducible expression of a second CAR that contains sequences of a second antibody.

In another aspect, the invention is directed to a murine, camelid, human, humanized anti-MUC1* antibody or antibody fragment or antibody-like protein that binds to the N-10 peptide, according to above, which inhibits the binding of NME protein to MUC1*. The NME may be NME1, NME6, NME7$_{AB}$, NME7-X1, NME7 or NME8.

In yet another aspect, the invention is directed to a single chain variable fragment (scFv) comprising a heavy and light chain variable regions connected via a linker, further comprising CDRs of antibodies that bind to MUC1* extracellular domain. The CDRs may be derived from MNC2, MNE6, 20A10, 3C2B1, 5C6F3, 25E6, 18G12, 28F9, 1E4, B12, B2, B7, B9, 8C7F3, and H11. The scFv may be one that possesses the SEQ ID NOS: 233, 235 and 237 (MN-E6); SEQ ID NOS: 239, 241, and 243 (MN-C2)

In still another aspect, the invention is directed to a chimeric antigen receptor (CAR) comprising a scFv or a humanized variable region that binds to the extracellular domain of a MUC1 that is devoid of tandem repeats, a linker molecule, a transmembrane domain and a cytoplasmic domain. The single chain antibody fragment may bind to
  (i) PSMGFR region of MUC1;
  (ii) PSMGFR peptide;

6

(iii) a peptide having amino acid sequence of QFNQYK-TEAASRYNLTISDVSVSDVPFPFSAQSGA (N-10) (SEQ ID NO:3)
  (iv) a peptide having amino acid sequence of ASRYNLTISDVSVSDVPFPFSAQSGA (N-19) (SEQ ID NO:4)
  (v) a peptide having amino acid sequence of NLTISDVSVSDVPFPFSAQSGA (N-23) (SEQ ID NO:5)
  (vi) a peptide having amino acid sequence of ISDVSVSDVPFPFSAQSGA (N-26) (SEQ ID NO:6)
  (vii) a peptide having amino acid sequence of SVSDVPFPFSAQSGA (N-30) (SEQ ID NO:7)
  (viii) a peptide having amino acid sequence of QFNQYKTEAASRYNLTISDVSVSDVPFPFS (N-10/C-5) (SEQ ID NO:8)
  (ix) a peptide having amino acid sequence of ASRYNLTISDVSVSDVPFPFS (N-19/C-5) (SEQ ID NO:9)
  (x) a peptide having amino acid sequence of FPFSAQSGA (N-36) (SEQ ID NO:10)

In the CAR as described above, portions of any of the variable regions set forth and described above, or combination thereof may be used in the extracellular domain of the CAR. The CAR also comprises a transmembrane region and a cytoplasmic tail that comprises sequence motifs that signal immune system activation. The extracellular domain may be comprised of murine, camelid, human, non-human, or humanized single chain antibody fragments of an MNC2, MNE6, 20A10, 3C2B1, 5C6F3, 25E6, 18G12, 28F9, 1E4, B12, B2, B7, B9, 8C7F3, and H11. Additional antibodies from which single chain antibody fragments may made include but are not limited to monoclonal antibodies that are like MNC2, MNE6, 20A10, 3C2B1, 5C6F3, 25E6, 18G12, 28F9, 1E4, B12, B2, B7, B9, 8C7F3, and H11 in that they have the same or very similar pattern of binding to subsets of peptides derived from the PSMGFR peptide, may not recognize a linear epitope or competitively inhibit the binding of NME1 or NME7$_{AB}$ to MUC1*, or recognize a MUC1 transmembrane cleavage product produced by cleavage by MMP9 or contain CDR sequences that are at least 80% homologous to the MNC2, MNE6, 20A10, 3C2B1, 5C6F3, 25E6, 18G12, 28F9, 1E4, B12, B2, B7, B9, 8C7F3, and H11 CDR consensus sequences.

In the CARs as described above, the extracellular domain may include a murine, camelid, human, non-human or humanized single chain antibody fragments of an MN-E6 scFv set forth as SEQ ID NOS: 233, 235, or 237), MN-C2 scFv (SEQ ID NOS: 239, 241, or 243), or 20A10 scFv as set forth as SEQ ID NOS: 1574-1575, 25E6 scFv as set forth as SEQ ID NOS: 1598-1599.

In any of the CARs described above, the cytoplasmic tail may be comprised of one or more of signaling sequence motifs CD3-zeta, CD27, CD28, 4-1BB, OX40, CD30, CD40, ICAm-1, LFA-1, ICOS, CD2, CD5, or CD7. In any of the CARs described above, the cytoplasmic tails may include mutations that dampen signaling. Such mutations include but are not limited to Tyrosines that are mutated to inhibit phosphorylation and signaling (Salter et al, 2018). In any of the CARs described above, the ITAMs of CD3-zeta may be mutated to inhibit or dampen signaling (Feucht et al 2019). In any of the CARs described above, the CD3 of the cytoplasmic tail may comprise mutations in the ITAMs including those referred to as 1XX. In any of the CARs described above, the T cell may be engineered to overexpress c-Jun as a method to inhibit T cell exhaustion (Lynn et al 2019).

In any of the CARs described above, the sequence may be CAR MN-E6 CD28/CD3z (SEQ ID NOS: 298); CAR MN-E6 4-1BB/CD3z (SEQ ID NOS: 301); CAR MN-E6 OX40/CD3z (SEQ ID NOS: 617); CAR MN-E6 CD28/4-1BB/CD3z (SEQ ID NOS: 304); CAR MN-E6 CD28/OX40/CD3z (SEQ ID NOS: 619); CAR MN-C2 CD3z (SEQ ID NOS: 607); CAR MN-C2 CD28/CD3z SEQ ID NOS: 609); CAR MN-C2 4-1BB/CD3z (SEQ ID NOS: 611 and SEQ ID NOS: 719); CAR MN-C2 OX40/CD3z (SEQ ID NOS: 613); CAR MN-C2 CD28/4-1BB/CD3z (SEQ ID NOS: 307); CAR MN-C2 CD28/OX40/CD3z (SEQ ID NOS: 615) or CAR MN-C3 4-1BB/CD3z (SEQ ID NOS: 601).

In another aspect, the invention is directed to a composition that includes at least two CARs with different extracellular domain units transfected into the same cell, which may be an immune cell, which may be derived from the patient requiring treatment for a cancer. The expression of the second CAR may be inducible and driven by the recognition of a target by the first CAR. The nucleic acid encoding the second CAR may be linked to an inducible promoter. The expression of the second CAR may be induced by an event that occurs specifically when the immune cell mounts an immune response to a target tumor cell. The antibody fragments of one or both of the CARs may direct the cell to a MUC1* positive tumor. The antibody fragments of the first and second CARs may bind to a MUC1* that is produced when MUC1 is cleaved by two different cleavage enzymes. Expression of the second CAR by the inducible promoter may be induced when the antibody fragment of the first CAR engages or binds to a MUC1 or MUC1* on the tumor. One way to do this is to induce expression of the second CAR when, or shortly after, an NFAT protein is expressed or translocated to the nucleus. For example, a sequence derived from an NFAT promoter region is put upstream of the gene for the second CAR. In this way, when the transcription factors that bind to the promoter of the NFAT protein are present in sufficient concentration to bind to and induce transcription of the NFAT protein, they will also bind to that same promoter that is engineered in front of the sequence for transcription of the second CAR. The NFAT protein may be NFAT1 also known as NFATc2, NFAT2 also known as NFATc or NFATc1, NFAT3 also known as NFATc4, NFAT4 also known as NFATc3, or NFAT5. In one aspect of the invention, the NFAT is NFATc1, NFATc3 or NFATc2. In one aspect of the invention, the NFAT is NFAT2 also known as NFATc1. SEQ ID NO:646 shows nucleic acid sequence of the upstream transcriptional regulatory region for NFAT2. The recognition unit of the second CAR may be an antibody fragment or a peptide, wherein the recognition units may bind to NME7, PD-1, PDL-1, or a checkpoint inhibitor.

The at least two CARs may have one CAR that does not have a tumor antigen targeting recognition unit and the other CAR does have a tumor antigen targeting recognition unit. In another aspect of the invention, one of the extracellular domain recognition units may bind to MUC1* extracellular domain. In another aspect of the invention, one of the extracellular domain recognition units may be an antibody fragment and the other is a peptide, which may be devoid of transmembrane and signaling motifs; the peptide may be a single chain antibody fragment or antibody. In another aspect of the invention, one of the recognition units may bind PD-1 or PDL-1. In another aspect of the invention, one extra cellular domain recognition unit is an anti-MUC1* antibody, antibody fragment or scFv chosen from the group consisting of MNC2, MNE6, 20A10, 3C2B1, 5C6F3, 25E6, 18G12, 28F9, 1E4, B12, B2, B7, B9, 8C7F3, and H11. The other recognition unit may be a CAR or may be an anti-NME7 antibody.

In another aspect, the invention is directed to a cell comprising a CAR with an extracellular domain that binds to the extra cellular domain of a MUC1 molecule that is devoid of tandem repeats. In another aspect, the invention is directed to a cell comprising a CAR with an extracellular domain that binds to a MUC1* transfected or transduced cell. The cell that includes the CAR may be an immune system cell, preferably a T cell, a natural killer cell (NK), a dendritic cell or mast cell.

In another aspect, the invention is directed to an engineered antibody-like protein.

In another aspect, the invention is directed to a method for treating a disease in a subject comprising administering an antibody according to any claim above, to a person suffering from the disease, wherein the subject expresses MUC1 aberrantly. The disease may be cancer, such as breast cancer, ovarian cancer, pancreatic cancer, lung cancer, colon cancer, gastric cancer or esophageal cancer.

In another aspect, the invention is directed to an antibody, antibody fragment or scFv comprising variable domain fragments derived from an antibody that binds to an extracellular domain of MUC1 isoform or cleavage product that is devoid of the tandem repeat domains. In a preferred embodiment, the antibody or antibody fragment binds to the N-10 peptide. The variable domain fragments may be derived from mouse monoclonal antibody MN-E6 (SEQ ID NO: 13 and 66) or from the humanized MN-E6 (SEQ ID NO: 39 and 94), or from MN-E6 scFv (SEQ ID NO: 233, 235 and 237). Or, the variable domain fragments may be derived from mouse monoclonal antibody MN-C2 (SEQ ID NO: 119 and 169) or from the humanized MN-C2 (SEQ ID NO: 145 and 195), or from MN-C2 scFv (SEQ ID NO: 239, 241 and 243). Or, the variable domain may be derived from monoclonal antibodies MN-18G12, MN-20A10, MN-25E6, MN-28F9, MN-5C6F3, MN-3C2B1, or MN-1E4. The heavy chain and light chain complementary determining region sequences for these antibodies are also set forth in the sequence listing herein.

In another aspect, the invention is directed to a method for the treatment of a person diagnosed with, suspected of having or at risk of developing a MUC1 or MUC1* positive cancer involving administering to the person an effective amount of the antibody, antibody fragment or scFv described above, wherein the species may be murine, camelid, human or humanized.

In another aspect, the invention is directed to a polypeptide comprising at least two different scFv sequences, wherein one of the scFv sequences is a sequence that binds to extracellular domain of MUC1 isoform or cleavage product that is devoid of the tandem repeat domains. The polypeptide may bind to
   (i) PSMGFR region of MUC1;
   (ii) PSMGFR peptide;
   (iii) a peptide having amino acid sequence of QFNQYK-TEAASRYNLTISDVSVSDVPFPFSAQSGA (N-10) (SEQ ID NO:3)
   (iv) a peptide having amino acid sequence of ASRYNLTISDVSVSDVPFPFSAQSGA (N-19) (SEQ ID NO:4)
   (v) a peptide having amino acid sequence of NLTISDVSVSDVPFPFSAQSGA (N-23) (SEQ ID NO:5)
   (vi) a peptide having amino acid sequence of ISDVSVSDVPFPFSAQSGA (N-26) (SEQ ID NO:6)

(vii) a peptide having amino acid sequence of SVSDVPFPFSAQSGA (N-30) (SEQ ID NO:7)

(viii) a peptide having amino acid sequence of QFNQYKTEAASRYNLTISDVSVSDVPFPFS (N-10/C-5) (SEQ ID NO:8)

(ix) a peptide having amino acid sequence of ASRYNLTISDVSVSDVPFPFS (N-19/C-5) (SEQ ID NO:9)

(x) a peptide having amino acid sequence of FPFSAQSGA (N-36) (SEQ ID NO:10)

The polypeptide may bind to a receptor on an immune cell, such as T cell, and in particular, CD3 on T-cell.

In another aspect, the invention is directed to a method of detecting presence of a cell that expresses MUC1* aberrantly, comprising contacting a sample of cells with the scFv-Fc described above and detecting for the presence of the binding of scFv-Fc to the cell. The cell may be cancer cell.

In another aspect, the invention is directed to a method for testing a subject's cancer for suitability of treatment with a composition comprising antibodies of the invention, which may be murine, camelid, human or humanized, or fragments thereof, or portions of the variable regions of antibodies MNC2, MNE6, 20A10, 3C2B1, 5C6F3, 25E6, 18G12, 28F9, 1E4, B12, B2, B7, B9, 8C7F3, or H11, comprising the steps of contacting a bodily specimen from the patient, in vitro, ex-vivo, or in vivo, with the antibody and determining that the patient exhibits aberrant expression of MUC1* compared to normal tissue or specimen. The antibody used in these diagnostics may be conjugated to an imaging agent.

In another aspect, the invention is directed to a method of treating a subject suffering from a disease comprising, exposing T cells from the subject, or from a donor, to MUC1* peptides wherein through various rounds of maturation, T cells develop MUC1* specific receptors, creating adapted T cells, and expanding and administering the adapted T cells to the donor patient who is diagnosed with, suspected of having, or is at risk of developing a MUC1* positive cancer. The MUC1* peptide is chosen from among the group:

(i) PSMGFR region of MUC1;

(ii) PSMGFR peptide;

(iii) a peptide having amino acid sequence of QFNQYK-TEAASRYNLTISDVSVSDVPFPFSAQSGA (N-10) (SEQ ID NO: 3)

(iv) a peptide having amino acid sequence of ASRYNLTISDVSVSDVPFPFSAQSGA (N-19) (SEQ ID NO: 4)

(v) a peptide having amino acid sequence of NLTISDVSVSDVPFPFSAQSGA (N-23) (SEQ ID NO: 5)

(vi) a peptide having amino acid sequence of ISDVSVSDVPFPFSAQSGA (N-26) (SEQ ID NO: 6)

(vii) a peptide having amino acid sequence of SVSDVPFPFSAQSGA (N-30) (SEQ ID NO: 7)

(viii) a peptide having amino acid sequence of QFNQYKTEAASRYNLTISDVSVSDVPFPFS (N-10/C-5) (SEQ ID NO: 8)

(ix) a peptide having amino acid sequence of ASRYNLTISDVSVSDVPFPFS (N-19/C-5) (SEQ ID NO: 9)

(x) a peptide having amino acid sequence of FPFSAQSGA (N-36) (SEQ ID NO: 10)

In one aspect of the invention, the antibody that is administered to a patient for the treatment or prevention of a MUC1 or MUC1* positive cancer is selected for its ability to bind to the N-10 peptide of the PSMGFR. The antibody can be administered alone, as a monovalent antibody, as an scFv, or a fragment of the antibody can be incorporated into a CAR, a BiTE or an ADC.

In one aspect of the invention, the antibody that is administered to a patient for the treatment or prevention of a MUC1 or MUC1* positive cancer is selected for its inability to recognize a linear epitope of MUC1 or MUC1*. The antibody can be administered alone, as a monovalent antibody, as an scFv, or a fragment of the antibody can be incorporated into a CAR, a BiTE or an ADC.

In one aspect of the invention, the antibody that is administered to a patient for the treatment or prevention of a MUC1 or MUC1* positive cancer is selected for its ability to recognize the MUC1 transmembrane cleavage product after it has been cleaved by MMP9. The antibody can be administered alone, as a monovalent antibody, as an scFv, or a fragment of the antibody can be incorporated into a CAR, a BiTE or an ADC.

In one aspect of the invention, the antibody that is administered to a patient for the treatment or prevention of a MUC1 or MUC1* positive cancer is selected for its ability to competitively inhibit the binding of $NME7_{AB}$ or NME7-X1 to the extra cellular domain of a MUC1 that is devoid of tandem repeats. The antibody can be administered alone, as a monovalent antibody, as an scFv, or a fragment of the antibody can be incorporated into a CAR, a BiTE or an ADC.

In another aspect, the invention is directed to a method of treating cancer in a patient comprising administering to the patient the immune cell of any of the above, in combination with a checkpoint inhibitor.

In the method above, any of the antibodies, or variable regions thereof, set forth in the following may be used: MNC2, MNE6, 20A10, 3C2B1, 5C6F3, 25E6, 18G12, 28F9, 1E4, B12, B2, B7, B9, 8C7F3, or H11.

In the method above, any of the variable regions set forth in the following may be used:

(i) an anti-MUC1* extracellular domain antibody or anti-N-10 antibody comprised of sequences of a humanized MN-E6 represented by humanized IgG2 heavy chain, or humanized IgG1 heavy chain, paired with humanized Kappa light chain, or humanized Lambda light chain;

(ii) an antibody of (i), wherein the humanized IgG2 heavy chain is SEQ ID NOS: 53, humanized IgG1 heavy chain is SEQ ID NO:57, humanized Kappa light chain is SEQ ID NO: 108, and humanized Lambda light chain is SEQ ID NO:112, or a sequence having 90%, 95% or 98% sequence identity thereof;

(iii) an anti-MUC1* extracellular domain antibody or anti-N-10 antibody comprised of sequences of a humanized MN-C2 represented by humanized IgG1 heavy chain, humanized IgG2 heavy chain, paired with humanized Lambda light chain, and humanized Kappa light chain;

(iv) an antibody of (iii), wherein the humanized IgG1 heavy chain MN-C2 (SEQ ID NOS: 159) or IgG2 heavy chain (SEQ ID NOS: 164) paired with Lambda light chain (SEQ ID NO: 219) or Kappa light chain (SEQ ID NO:213), or a sequence having 90%, 95% or 98% sequence identity thereof, In the method above, in the CAR, the extracellular domain may be comprised of humanized single chain antibody fragments of MNC2, MNE6, 20A10, 3C2B1, 5C6F3, 25E6, 18G12, 28F9, 1E4, B12, B2, B7, B9, 8C7F3, or H11. The extracellular domain may be comprised of humanized single chain antibody fragments of an MN-E6 scFv set forth as SEQ ID NOS: 233, 235, or 237), MN-C2 scFv (SEQ ID NOS: 239, 241, or 243). In the CAR, the cytoplasmic tail may be comprised of one or more of signaling sequence motifs CD3-zeta, CD27, CD28, 4-1BB, OX40, CD30, CD40, ICAm-1, LFA-1, ICOS, CD2, CD5, or CD7.

The method above may include at least two CARs with different extracellular domain units transfected into the same cell. One of the extracellular domain recognition units may bind to MUC1* extracellular domain. One of the extracellular domain recognition units may bind to PD-1. One of the extracellular domain recognition units may be an antibody fragment and the other may be a peptide or an anti-MUC1* antibody fragment.

The method may include an immune cell transfected or transduced with a plasmid encoding a CAR and a plasmid encoding a non-CAR species that is expressed from an inducible promoter. The non-CAR species may be expressed from an inducible promoter that is activated by elements of an activated immune cell. The non-CAR species may be expressed from an NFAT inducible promoter. The NFAT may be NFATc1, NFATc3 or NFATc2. The cleavage enzyme may be MMP2, MMP3, MMP9, MMP13, MMP14, MMP16, ADAM10, ADAM17, or ADAM28, or a catalytically active fragment thereof. The non-CAR species may be a cytokine. The cytokine may be IL-7, IL-12, IL-15 or IL-18.

The present invention is directed to an antibody, or fragment thereof, for the diagnosis, treatment or prevention of cancers wherein the antibody specifically binds to the PSMGFR peptide (SEQ ID NO: 2) or a fragment thereof of the peptide.

The antibody binds to the N-10 peptide (SEQ ID NO:3), N-19 peptide (SEQ ID NO:4), N-23 peptide (SEQ ID NO:5), N-26 peptide (SEQ ID NO:6), N-30 peptide (SEQ ID NO:7), N-10/C-5 peptide (SEQ ID NO:8), N-19/C-5 peptide (SEQ ID NO:9), or C-5 peptide (SEQ ID NO:825).

The antibody interacts with a peptide comprising conformational epitope SVSDV (SEQ ID NO: 1751) and FPSA (SEQ ID NO:1791) within N-26 sequence ISDVSVSDVPFPFSAQSGA (SEQ ID NO: 6), wherein mutation or deletion of FPFS (SEQ ID NO:1747) destroys binding of the antibody or fragment thereof to the N-26 peptide.

The antibody interacts with a peptide comprising conformational epitope ASRYNLT (SEQ ID NO: 1745), SVSDV (SEQ ID NO:1751), and FPSA (SEQ ID NO:1791) within the N-19 sequence ASRYNLT ISDVSVSDVPFPFSAQSGA (SEQ ID NO:4), wherein mutation or deletion of ASRYNLT (SEQ ID NO: 1745) destroys binding of the antibody or fragment thereof to the N-26 peptide.

The antibody does not bind to the C-10 peptide (SEQ ID NO:825).

The antibody binds to the N-10 peptide (SEQ ID NO:3), but not to the C-10 peptide (SEQ ID NO: 825).

The antibody inhibits interaction between NME7$_{AB}$ and MUC1*.

The antibody inhibits interaction between NME7$_{AB}$ and PSMGFR peptide (SEQ ID NO:2).

The antibody inhibits interaction between NME7$_{AB}$ and N-10 peptide (SEQ ID NO:3), N-19 peptide (SEQ ID NO:4), N-23 peptide (SEQ ID NO:5), N-26 peptide (SEQ ID NO:6), N-30 peptide (SEQ ID NO: 7), N-10/C-5 peptide (SEQ ID NO:8), N-19/C-5 peptide (SEQ ID NO:9), or C-5 peptide (SEQ ID NO: 825).

The antibody recognizes a MUC1 transmembrane enzymatic cleavage product.

In the above, the cleavage enzyme is MMP14 or MMP9 or a catalytically active fragment thereof of the enzyme.

The antibody binds to PSMGFR (SEQ ID NO:2) or fragment thereof in which presence of an amino acid sequence within PSMGFR (SEQ ID NO:2) induces binding of the antibody to the PSMGFR.

The amino acid sequence of the binding conformationally inducing peptide is present in N-10 peptide (SEQ ID NO:3).

The antibody does not bind to a linear form of the binding conformationally inducing peptide sequence wherein the linear form of the peptide is a denatured form.

The binding conformationally inducing peptide sequence is in the N-26 peptide sequence ISDVSVSDVPFPFSAQSGA (SEQ ID NO:6), wherein mutation or deletion of FPFS (SEQ ID NO:1747) destroys binding of the antibody or fragment thereof to the N-26 peptide.

The binding conformationally inducing peptide sequence is located within the N-19 sequence ASRYNLTISDVSVSDVPFPFSAQSGA (SEQ ID NO:4), wherein mutation or deletion of ASRYNLT (SEQ ID NO: 1745) destroys binding of the antibody or fragment thereof to the N-19 peptide.

The binding inducing peptide sequence may be located within the N-26 sequence ISDVSVSDVPFPFSAQSGA (SEQ ID NO:6), wherein mutation or deletion within FPFS (SEQ ID NO: 1747) destroys binding of the antibody or fragment thereof to PSMGFR.

The antibodies may have a consensus sequence.

heavy chain CDR1 comprises consensus sequence at least 90% identical to sequence: F or I at position 1, T at position 2, F at position 3, S at position 4, T, G, or R at position 5, Y at position 6, A, G or T at position 7, M at position 8 and S at position 9;

heavy Chain CDR2 comprises consensus sequence at least 90% identical to sequence: T at position 1, I or S at position 2, I or S at position 3, G or R at position 5, G or A at position 6, T or I at position 9, Y at position 10, Y at position 11, P or S at position 12 and DSVKG (SEQ ID NO: 1793) for positions 13-17;

heavy chain CDR3 comprises consensus sequence at least 90% identical to sequence: _G, L, or N at position 2, G or T at position 4, Y at position 7, D or E at position 12, A at position 14, and Y at position 15;

light chain CDR1 comprises consensus sequence at least 90% identical to sequence: K or R at position 1, A or S at position 2, S at position 3, K or Q at position 4, S at position 5, L or V at position 6, L at position 7, T or S at position 10, Y at position 15, and I, L or M at position 16;

light Chain CDR2 comprises consensus sequence at least 90% identical to sequence: L or W, or S at position 1, A or T at position 2, S at position 3, N or T at position 4, L or R at position 5, E or A at position 6, and S at position 7; and light chain CDR3 comprises consensus sequence at least 90% identical to sequence: Q at position 1, H or Q at position 2, S, Q or R at position 3, R, S or Y at position 4, E, L, or S at position 5, L or S at position 6, P or S at position 7, F or L at position 8 and T at position 9.

An antibody binding conformationally inducing peptide is within the N-26 sequence ISDVSVSDVPFPFSAQSGA (SEQ ID NO:6), wherein mutation or deletion within FPFS (SEQ ID NO: 1747), SVSDV (SEQ ID NO:1751), or ASRYNLT (SEQ ID NO:1745) destroys binding of the antibody or fragment thereof to PSMGFR.

The antibody may have a further consensus sequence, wherein heavy chain CDR1 comprises consensus sequence at least 90% identical to sequence: F or I at position 1, T or A at position 2, F at position 3, S at position 4, T, G, or R at position 5, Y or F at position 6, A, G or T at position 7, M at position 8 and S at position 9;

heavy Chain CDR2 comprises consensus sequence at least 90% identical to sequence: T or A at position 1, I or S at position 2, I or S at position 3, N, S, T or G at position 4, G or R at position 5, G or A at position 6, G, T, or D at position 7, Y, K, H or S at position 8, T or I at position 9, Y or F at position 10, Y at position 11, P or S at position 12 and D at position 13, S or T at position 14, V or L at position 15 and KG for positions 16-17;

heavy chain CDR3 comprises consensus sequence at least 90% identical to sequence: G, L, or N at position 2, G, T, or Y at position 3, G or T at position 4, Y at position 7, Y, A, or G at position 10, M, D or F at position 11, D or E at position 12 and AY at position 14-15;

light chain CDR1 comprises consensus sequence _ at least 90% identical to sequence: K or R at position 1, A or S at position 2, S or R at position 3, S, Y, I or V at position 8, T or S at position 10, G, S, D, or Q at position 12, V, Y, K or N at position 13, N, S, or T at position 14, Y or F at position 15, and I, L or M at position 16;

light Chain CDR2 comprises consensus sequence at least 90% identical to sequence: A, T or V at position 2, S at position 3, N, T, or K at position 4, L or R at position 5, E, A, F or D at position 6, and S at position 7; and light chain CDR3 comprises consensus sequence at least 90% identical to sequence: Q, F or W at position 1, H or Q at position 2, R, S, T, Y or N at position 4, E, L, S or H at position 5, L, S, V, D or Y at position 6, P or S at position 7, and T at position 9.

The antibody above which may be MNC2, having heavy chain CDR1 comprises consensus sequence FTFSGYAMS (SEQ ID NO: 1794);

heavy Chain CDR2 comprises consensus sequence TIS-SGGTYIYYPDSVKG (SEQ ID NO: 127);

heavy chain CDR3 comprises consensus sequence -LGGDNYYEYFDV-- (SEQ ID NO: 131);

light chain CDR1 comprises consensus sequence RASKS--VSTSGYSYMH (SEQ ID NO: 173);

light Chain CDR2 comprises consensus sequence LASN-LES (SEQ ID NO: 177); and light chain CDR3 comprises consensus sequence QHS-RELPFT (SEQ ID NO: 181).

MNE6, having heavy chain CDR1 comprises consensus sequence FTFSRYGMS (SEQ ID NO: 1795);

heavy Chain CDR2 comprises consensus sequence TIS-GGGTYIYYPDSVKG (SEQ ID NO: 21);

heavy chain CDR3 comprises consensus sequence DNYGRNYDYGMDY-- (SEQ ID NO: 25);

light chain CDR1 comprises consensus sequence ------- SATSSVSYIH (SEQ ID NO: 70);

light Chain CDR2 comprises consensus sequence STSN-LAS (SEQ ID NO: 74); and light chain CDR3 comprises consensus sequence QQRSSSPFT (SEQ ID NO: 78).

B2, having heavy chain CDR1 comprises consensus sequence FAF-STFAMS (SEQ ID NO: 1796);

heavy Chain CDR2 comprises consensus sequence AIS-NGGGYTYYPDTLKG (SEQ ID NO: 1439);

heavy chain CDR3 comprises consensus sequence ---- RYYDLYFDL-- (SEQ ID NO: 1443);

light chain CDR1 comprises consensus sequence RSSQNIV-HSNGNTYLE (SEQ ID NO: 1449);

light Chain CDR2 comprises consensus sequence KVSNRFS (SEQ ID NO: 467); and light chain CDR3 comprises consensus sequence FQD-SHVPLT (SEQ ID NO: 1381).

B7, having heavy chain CDR1 comprises consensus sequence FTFSRYGMS (SEQ ID NO: 1795);

heavy Chain CDR2 comprises consensus sequence TIS-SGGTYIYYPDSVKG (SEQ ID NO: 127);

heavy chain CDR3 comprises consensus sequence DNYGSSYDYAMDY--; (SEQ ID NO: 1471) light chain CDR1 comprises consensus sequence RSSQTIV-HSNGNTYLE (SEQ ID NO: 463);

light Chain CDR2 comprises consensus sequence KVSNRFS (SEQ ID NO: 467); and light chain CDR3 comprises consensus sequence FQD-SHVPLT (SEQ ID NO: 1381).

B9, having heavy chain CDR1 comprises consensus sequence FTFSRYGMS (SEQ ID NO: 1795);

heavy Chain CDR2 comprises consensus sequence TIS-SGGTYIYYPDSVKG (SEQ ID NO: 127);

heavy chain CDR3 comprises consensus sequence DNYGSSYDYAMDY-- (SEQ ID NO: 1471);

light chain CDR1 comprises consensus sequence ------- SASSSVSYMH (SEQ ID NO: 1561);

light Chain CDR2 comprises consensus sequence TTSN-LAS (SEQ ID NO: 1565); and light chain CDR3 comprises consensus sequence QQRSSYPF—(SEQ ID NO: 1569).

8C7F3, having heavy chain CDR1 comprises consensus sequence FTF-STYAMS (SEQ ID NO: 1797);

heavy chain CDR2 comprises consensus sequence AIS-NGGGYTYYPDSLKG (SEQ ID NO: 1363);

heavy chain CDR3 comprises consensus sequence ---- RYYDHYFDY-- (SEQ ID NO: 1367);

light chain CDR1 comprises consensus sequence --RAS-ESVATYGNNFMQ (SEQ ID NO: 1431);

light Chain CDR2 comprises consensus sequence LAST-LDS (SEQ ID NO: 1509); and light chain CDR3 comprises consensus sequence QQNNEDPPT (SEQ ID NO: 1513).

H11, having heavy chain CDR1 comprises consensus sequence FAF-STFAMS (SEQ ID NO: 1796);

heavy Chain CDR2 comprises consensus sequence AIS-NGGGYTYYPDTLKG (SEQ ID NO: 1439);

heavy chain CDR3 comprises consensus sequence ---- RYYDLYFDL-- (SEQ ID NO: 1443);

light chain CDR1 comprises consensus sequence RSSQNIV-HSNGNTYLE (SEQ ID NO: 1449);

light Chain CDR2 comprises consensus sequence KVSNRFS (SEQ ID NO: 467); and light chain CDR3 comprises consensus sequence FQD-SHVPLT (SEQ ID NO: 1381).

B12, having heavy chain CDR1 comprises consensus sequence SYGVH (SEQ ID NO: 1417);

heavy Chain CDR2 comprises consensus sequence VIWPGGGSTNYNSTLMSRM (SEQ ID NO: 1421);

heavy chain CDR3 comprises consensus sequence DRT-PRVGAWFAY (SEQ ID NO: 1425); and light chain CDR1 comprises consensus sequence RAS-ESVATYGNNFMQ (SEQ ID NO: 1431);

light Chain CDR2 comprises consensus sequence LAST-LDS (SEQ ID NO: 1509); and light chain CDR3 comprises consensus sequence QQNNEDPPT (SEQ ID NO: 1513). 20A10, having heavy chain CDR1 comprises consensus sequence FTF-STYAMS (SEQ ID NO: 1797);

heavy Chain CDR2 comprises consensus sequence -SIG-RAGSTYYSDSVKG (SEQ ID NO: 997);

heavy chain CDR3 comprises consensus sequence ---GPIYNDYDEFAY (SEQ ID NO: 1001);

light chain CDR1 comprises consensus sequence KSSQSVLYSSNQKNYLA (SEQ ID NO: 1009);

light Chain CDR2 comprises consensus sequence WAST-RES (SEQ ID NO: 1013); and light chain CDR3 comprises consensus sequence HQYLSSLT (SEQ ID NO: 1017).

3C2B1, having heavy chain CDR1 comprises consensus sequence ITF-STYTMS (SEQ ID NO: 1798);

heavy Chain CDR2 comprises consensus sequence TISTGGDKTYYSDSVKG (SEQ ID NO: 1393);

heavy chain CDR3 comprises consensus sequence -GT-TAMYYYAMDY (SEQ ID NO: 1397);

light chain CDR1 comprises consensus sequence RASKS---ISTSDYNYIH (SEQ ID NO: 1803);

light Chain CDR2 comprises consensus sequence LASN-LES (SEQ ID NO: 177); and light chain CDR3 comprises consensus sequence QHS-RELPLT (SEQ ID NO: 1411).

In another aspect, the invention is directed to an antibody, or fragment thereof, for the diagnosis, treatment or prevention of cancers that requires presence of antibody binding conformationally inducing peptide ASRYNLT (SEQ ID NO:1745) of PSMGFR (SEQ ID NO:2). The antibody may be 25E6, having heavy chain CDR1 comprises consensus sequence FTFSSYGMS (SEQ ID NO: 1799);

heavy Chain CDR2 comprises consensus sequence TIS-NGGRHTFYPDSVKG (SEQ ID NO: 1029);

heavy chain CDR3 comprises consensus sequence QTGTEGWFAY (SEQ ID NO: 1033);

light chain CDR1 comprises consensus sequence KSSQSLLDSDGKTYLN (SEQ ID NO: 1041);

light Chain CDR2 comprises consensus sequence LVSK-LDS (SEQ ID NO: 981); and light chain CDR3 comprises consensus sequence WQGTHFPQT (SEQ ID NO: 1049).

In another aspect, the invention is directed to an antibody, or fragment thereof, for the diagnosis, treatment or prevention of cancers that requires presence of antibody binding conformationally inducing peptide SVSDV (SEQ ID NO: 1751) of PSMGFR (SEQ ID NO:2). The antibody may be 5C6F3, having heavy chain CDR1 comprises consensus sequence FTF-STYAMS (SEQ ID NO: 1797);

heavy Chain CDR2 comprises consensus sequence AIS-NGGGYTYYPDSLKG (SEQ ID NO: 1363);

heavy chain CDR3 comprises consensus sequence RYYDHYFDY (SEQ ID NO: 1367);

light chain CDR1 comprises consensus sequence RSSQ-TIVHSNGNTYLE (SEQ ID NO: 463);

light Chain CDR2 comprises consensus sequence KVSNRFS (SEQ ID NO: 467); and light chain CDR3 comprises consensus sequence FQD-SHVPLT (SEQ ID NO: 1381).

The antibody or fragment thereof according all of the above may be murine, camelid, human or humanized. The antibody fragment may be scFv or scFv-Fc, which variable regions thereof may be murine, camelid, human or humanized.

In another aspect, the invention is directed to a chimeric antigen receptor (CAR) comprising the antibody fragments of above, and may further comprise mutations in the co-stimulatory domain or CD3-zeta signaling domain. Tyrosines may be mutated in CD28 or 4-1BB. CD3-zeta may contain 1XX mutations.

In another aspect, the invention is directed to an immune cell comprising the CAR of above. Immune cell may be T cell, NK cell, dendritic cell, or mast cell.

In another aspect, the invention is directed to a cell composition expressed in a cell comprising a CARs of above, and second entity having a biological recognition unit that has a specificity that is different from that of the CAR. The second entity may bind PD-1, PDL-1, or other checkpoint inhibitor, or NME7, or a cytokine such as IL-12 or IL-18, or c-Jun.

In yet another aspect, the invention is directed to an immune cell engineered to express a nucleic encoding a CAR of above and a nucleic acid encoding a second entity as in any of the claims above wherein the second entity expressed from an inducible promoter. The second entity may be expressed from an inducible promoter that is activated by elements of an activated immune cell. The second entity may be expressed from an NFAT inducible promoter. NFAT may be NFATc1, NFATc3 or NFATc2. The second entity may be a cytokine such as IL-7, IL-15, or IL-18. The nucleic acids encoding the second entity may be inserted into a Foxp3 promoter or enhancer region, wherein the cytokine is IL-18. The cytokine may be expressed from an NFAT inducible promoter.

In another aspect, the invention is directed to a BiTE construct comprising the antibody fragment of above.

In yet another aspect, the invention is directed to an antibody drug conjugate (ADC) comprising the antibody or antibody fragment of above.

The present invention is directed to an antibody or fragment thereof that specifically binds to PSMGFR (SEQ ID NO:2) and N-10 (SEQ ID NO:3); and does not bind to full-length MUC1;

does not bind to C-10 (SEQ ID NO:825);

competitively inhibits binding of NME1 or NME7$_{AB}$ to MUC1* extra cellular domain or a PSMGFR peptide;

recognizes a MUC1* generated by cleavage by a cleavage enzyme;

recognizes a conformational epitope and not a linear epitope; or is cancer selective by immunohistochemistry on tissues.

Four of the criteria (i)-(vi) may be satisfied. Five of the criteria (i)-(vi) may be satisfied. Six of the criteria (i)-(vi) may be satisfied. At least criteria (vi) may be satisfied. Cleavage enzyme may be MMP-9.

In all of the above, the cancer may be breast cancer, pancreatic cancer, ovarian cancer, lung cancer, colon cancer, gastric cancer or esophageal cancer.

The present invention is also directed to a method of diagnosing, treating or preventing cancer by administering the antibodies and fragments disclosed herein to a cancer patient in need thereof that has been identified as expressing MUC1 aberrantly and expressing truncated MUC1, such as MUC1*.

These and other objects of the invention will be more fully understood from the following description of the invention, the referenced drawings attached hereto and the claims appended hereto.

BRIEF DESCRIPTION OF THE DRAWINGS

The present invention will become more fully understood from the detailed description given herein below, and the accompanying drawings which are given by way of illustration only, and thus are not limitative of the present invention, and wherein;

FIGS. 1A-1D show cell growth assay graphs of MUC1* positive cells treated with either bivalent 'bv' anti-MUC1* antibody, monovalent 'mv' or Fab, NM23-H1 dimers or NME7-AB. Bivalent anti-MUC1* antibodies stimulate growth of cancer cells whereas the monovalent Fab inhibits growth (FIG. 1A-1B). Classic bell-shaped curve indicates ligand induced dimerization stimulates growth. Dimeric NM23-H1, aka NME1, stimulates growth of MUC1* positive cells but siRNA to suppress MUC1 expression eliminate its effect (FIG. 1C). NME7-AB also stimulates the growth of MUC1* positive cells (FIG. 1D).

FIGS. 2A-2I show results of ELISA assays. MUC1* peptides PSMGFR, PSMGFR minus 10 amino acids from the N-terminus aka N-10, or PSMGFR minus 10 amino acids from the C-terminus, aka C-10 are immobilized on the plate and the following are assayed for binding: NME7-AB (FIG. 2A), MN-C2 monoclonal antibody (FIG. 2B), MN-E6 monoclonal antibody (FIG. 2C), or dimeric NME1 (FIG. 2D). These assays show that NME1, NME7-AB and monoclonal antibodies MN-C2 and MN-E6 all require the first membrane proximal 10 amino acids of the MUC1* extracellular domain to bind. MUC1* peptides PSMGFR minus 10 amino acids from the N-terminus aka N-10, or PSMGFR minus 10 amino acids from the C-terminus, aka C-10, are immobilized on the plate and the following are assayed for binding: MN-C3 (FIG. 2E) and MN-C8 (FIG. 2F). FIG. 2G shows the amino acid sequence of the PSMGFR peptide. FIG. 2H shows the amino acid sequence of the N-10 peptide. FIG. 2I shows the amino acid sequence of the C-10 peptide. Figure discloses SEQ ID NOS 2-3, and 825, respectively, in order of appearance.

FIGS. 3A-3C show results of competitive ELISA assays. The PSMGFR MUC1* peptide is immobilized on the plate and dimeric NM23-H1, aka NME1, is added either alone or after the MN-E6 antibody has been added (FIG. 3A). The same experiment was performed wherein NM23-H7, NME7-AB, is added alone or after MN-E6 has been added (FIG. 3B). Results show that MN-E6 competitively inhibits the binding of MUC1* activating ligands NME1 and NME7. In a similar experiment (FIG. 3C), PSMGFR or PSMGFR minus 10 amino acids from the N-terminus, aka N-10, is immobilized on the plate. Dimeric NM23-H1 is then added. Anti-MUC1* antibodies MN-E6, MN-C2, MN-C3 or MN-C8 are then tested for their ability to compete off the NM23-H1. Results show that although all three antibodies bind to the PSMGFR peptides, MN-E6 and MN-C2 competitively inhibit binding of the MUC1* activating ligands.

FIGS. 4A-4F show FACS scans of anti-MUC1* antibody huMN-C2scFv binding specifically to MUC1* positive cancer cells and MUC1* transfected cells but not MUC1* or MUC1 negative cells. ZR-75-1, aka 1500, MUC1* positive breast cancer cells were stained with 1:2 or 1:10 dilutions of the 1.5 ug/ml humanized MN-C2. After two washes, cells were stained with secondary antibody, Anti-Penta-His antibody conjugated to Alexa™ 488 (Qiagen) dilutions of 1:200 (FIG. 4A), 1:50 (FIG. 4B), or 1:10 (FIG. 4C) to detect the 6× His tag (SEQ ID NO: 1800) on the huMN-C2 scFv. FIG. 4A shows huMN-C2 binding to ZR-75-1 breast cancer cells where secondary antibody is added at a 1:200 dilution. FIG. 4B shows huMN-C2 binding to ZR-75-1 breast cancer cells where secondary antibody is added at a 1:50 dilution. FIG. 4C shows huMN-C2 binding to ZR-75-1 breast cancer cells where secondary antibody is added at a 1:10 dilution. Flow cytometric analysis revealed a concentration-dependent shift of a subset of cells, indicating specific binding, which is unseen in the absence of the MN-C2 scFv (FIG. 4A-4C). FIG. 4D shows anti-MUC1* antibody MN-E6 staining of MUC1 negative HCT-116 colon cancer cells transfected with the empty vector, single cell clone #8. FIG. 4E shows anti-MUC1* antibody MN-E6 staining of HCT-116 colon cancer cells transfected with MUC1* single cell clone #10. FIG. 4F shows anti-MUC1* antibody MN-E6 staining of ZR-75-1, aka 1500, MUC1* positive breast cancer cells. As the FACS scans show, both MN-C2 and MN-E6 only stain MUC1* positive cells and not MUC1 or MUC1* negative cells.

FIGS. 6A-6B show graphs of cancer cell growth inhibition by MUC1* antibody variable region fragment humanized MN-C2 scFv. hMN-C2 scFv potently inhibited the growth of ZR-75-1, aka 1500, MUC1* positive breast cancer cells (FIG. 6A) and T47D MUC1* positive breast cancer cells (FIG. 6B) with approximately the same EC-50 as the in vitro ELISAs.

FIGS. 9A-9B show graphs of ELISAs wherein the assay plate surface was immobilized with either PSMGFR peptide, PSMGFR minus 10 amino acids from the N-terminus or minus 10 amino acids from the C-terminus. The MN-C3 antibody variants were then assayed for binding to the various MUC1* peptides. FIG. 9A shows purified mouse monoclonal MN-C3 antibody; and FIG. 9B shows the humanized MN-C3 scFv-Fc. ELISAs show binding to the PSMGFR peptide as well as to certain deletion peptides.

In FIGS. 10A-10J and 11A-11J, Tissue arrays comprising specimens from 240 breast cancer patients were stained with an antibody (VU4H5) that recognizes full-length MUD, (left) or stained with an antibody that recognizes MUC1.* (MN-C2). The data show that most or all (green boxes) of the MUC1 on cancerous tissue is MUCV and not MUC1 full-length (Mudd.-FL). The data further show that MN-C2 monoclonal antibody binds to cancerous tissue but not the healthy control tissue.

FIGS. 10A-10J. FIGS. 10A10B are photographs of breast cancer tissue arrays. FIG. 10A was stained with VU4H5 which recognizes MUC1-FL (full length); FIG. 10B was stained with mouse monoclonal antibody MN-C2 which recognizes cancerous MUC1*. Following automated staining (Clarient Diagnostics), the tissue staining was scored using Allred scoring method which combines an intensity score and a distribution score. FIGS. 10C10F are color coded graphs showing the score calculated for MUC1 full-length staining for each patient's tissue. FIGS. 10G10J are color coded graphs showing the score calculated for MUC1* staining for each patient's tissue.

FIGS. 11A-11J. FIGS. 11A11B are photographs of breast cancer tissue arrays. FIG. 11A was stained with VU4H5 which recognizes MUC1-FL (full length); FIG. 11B was stained with mouse monoclonal antibody MN-C2 which recognizes cancerous MUC1*. Following automated staining (Clarient Diagnostics), the tissue staining was scored using Allred scoring method which combines an intensity score and a distribution score. FIGS. 11C-11F are color coded graphs showing the score calculated for MUC1 full-length staining for each patient's tissue. FIGS. 11G-11J are color coded graphs showing the score calculated for MUC1* staining for each patient's tissue.

FIGS. 12A-12H show photographs of normal breast and breast cancer tissues stained with humanized MN-E6-scFv-Fc biotinylated anti-MUC1* antibody at 2.5 ug/mL, then stained with a secondary streptavidin HRP antibody. FIG. 12A is a normal breast tissue. FIGS. 12B-12D are breast cancer tissues from patients as denoted in the figure. FIGS. 12E-12H are photographs of the corresponding serial sections that were stained with the secondary antibody alone.

FIG. 13A is a normal breast tissue. FIGS. 13B-13C are breast cancer tissues from patients as denoted in the figure. FIGS. 13D-13F are photographs of the corresponding serial sections that were stained with the secondary antibody alone.

FIGS. 14A-14D are breast cancer tissues from patient #300. FIGS. 14E-14H are breast cancer tissues from metastatic patient #291.

FIG. 15A is a normal lung tissue. FIGS. 15B15C are lung cancer tissues from patients as denoted in the figure. FIGS. 15D-15F are photographs of the corresponding serial sections that were stained with the secondary antibody alone.

FIG. 16A is a normal lung tissue. FIGS. 16B16C are lung cancer tissues from patients as denoted in the figure. FIGS. 16D-16F are photographs of the corresponding serial sections that were stained with the secondary antibody alone.

FIG. 17A is a normal lung tissue. FIGS. 17B-17C are lung cancer tissues from patients as denoted in the figure. FIGS. 17D-17F are photographs of the corresponding serial sections that were stained with the secondary antibody alone.

FIG. 18A is a normal lung tissue. FIGS. 18B-18C are lung cancer tissues from patients as denoted in the figure. FIGS. 18D-18F are photographs of the corresponding serial sections that were stained with the secondary antibody alone.

FIG. 19A is a normal small intestine tissue. FIG. 19B is small intestine cancer from patient as denoted in the figure. FIGS. 19C-19D are photographs of the corresponding serial sections that were stained with the secondary antibody alone.

Figures 20A, 20B, 20C, 20D, 20E, 20F, 20G, 20H:
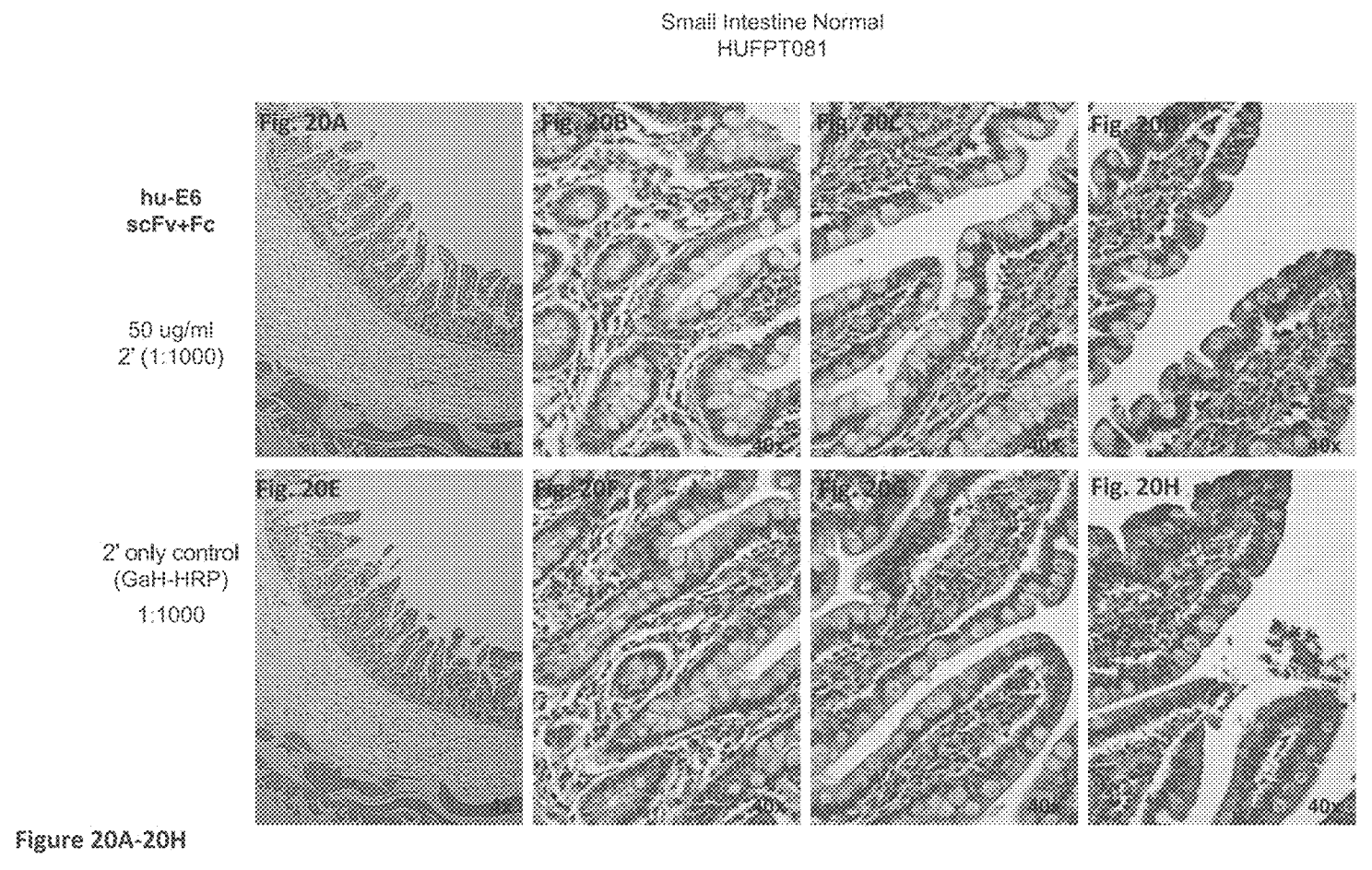

FIGS. 20A-20H show photographs of normal small intestine tissues stained with humanized MN-E6-scFv-Fc anti-MUC1* antibody at 50 ug/mL, then stained with a secondary goat-anti-human HRP antibody. FIGS. 20A-20D are normal small intestine tissue. FIGS. 20E-20H are photographs of the corresponding serial sections that were stained with the secondary antibody alone.

FIGS. 21A-21D are cancerous small intestine tissue from a patient as denoted in figure. FIGS. 21E-21H are photographs of the corresponding serial sections that were stained with the secondary antibody alone.

FIGS. 22A-22D are cancerous small intestine tissue from a patient as denoted in figure. FIGS. 22E-22H are photographs of the corresponding serial sections that were stained with the secondary antibody alone.

FIGS. 23A-23D are normal colon. FIGS. 23E-23H are photographs of the corresponding serial sections that were stained with the secondary antibody alone.

FIGS. 24A-24D are colon cancer tissue from a metastatic patient as denoted in figure. FIGS. 24E-24H are photographs of the corresponding serial sections that were stained with the secondary antibody alone.

FIGS. 25A-25D are colon cancer tissue from a Grade 2 patient as denoted in figure. FIGS. 25E-25H are photographs of the corresponding serial sections that were stained with the secondary antibody alone.

FIGS. 26A-26D are colon cancer tissue from a metastatic patient as denoted in figure. FIGS. 26E-26H are photographs of the corresponding serial sections that were stained with the secondary antibody alone.

FIGS. 27A-27D are prostate cancer tissue from a patient as denoted in figure. FIGS. 27E-27H are photographs of the corresponding serial sections that were stained with the secondary antibody alone.

FIGS. 28A-28D are prostate cancer tissue from a patient as denoted in figure. FIGS. 28E-28H are photographs of the corresponding serial sections that were stained with the secondary antibody alone.

FIGS. 29A-29D are prostate cancer tissue from a patient as denoted in figure. FIGS. 29E-29H are photographs of the corresponding serial sections that were stained with the secondary antibody alone.

FIG. 30A shows the pie chart of score of anti-MUC1* antibody staining. FIG. 30B shows a photograph of the array stained with the antibody. FIGS. 30C-30D show magnified photographs of two of the breast cancer specimens from the array. FIGS. 30E-30F show more magnified photographs of the portion of the specimen that is marked by a box.

FIGS. 31A-31F show photographs of an ovarian cancer array stained with anti-MUC1* antibody huMNC2scFv. The first score shown is the Allred score and the second is the tumor grade. The percentage of the array that scored zero, weak, medium or strong is graphed as a pie chart. FIG. 31A shows the pie chart of score of anti-MUC1* antibody staining. FIG. 31B shows a photograph of the array stained with the antibody. FIGS. 31C-31D show magnified photographs of two of the breast cancer specimens from the array. FIGS. 31E-31F show more magnified photographs of the portion of the specimen that is marked by a box.

FIG. 32A shows the pie chart of score of anti-MUC1* antibody staining. FIG. 32B shows a photograph of the array stained with the antibody. FIGS. 32C-32D show magnified photographs of two of the breast cancer specimens from the array. FIGS. 32E-32F show more magnified photographs of the portion of the specimen that is marked by a box.

FIGS. 33A-33F show photographs of a lung cancer array stained with anti-MUC1* antibody huMNC2scFv. The first score shown is the Allred score and the second is the tumor grade. The percentage of the array that scored zero, weak, medium or strong is graphed as a pie chart. FIG. 33A shows the pie chart of score of anti-MUC1* antibody staining. FIG. 33B shows a photograph of the array stained with the antibody. FIGS. 33C-33D show magnified photographs of two of the breast cancer specimens from the array. FIGS. 33E-33F show more magnified photographs of the portion of the specimen that is marked by a box.

HCT-116 are a MUC1-negative colon cancer cell line; HCT-MUC1* is a stable cell line, pre-sorted to be 100% positive for MUC1*; HCT-MUC1-18 is a single cell clone of HCT's transfected with MUC1-Full-length (43 TRs). HCT-MUC1-18 is resistant to MUC1 cleavage (−1.0% cleaved).

FIGS. 35A-35D show FACS scans of cells expressing either no MUC1, MUC1* or full-length MUC1, wherein the cells were probed with either MNC2 or VU4H5. FIG. 35A shows MUC1 negative HCT-116 colon cancer cells probed with antibody MNC2. FIG. 35B shows HCT cells that have been transfected with MUC1* wherein the extra cellular domain is just the sequence of the PSMGFR peptide wherein the cells are probed with antibody MNC2. FIG. 35C shows HCT-MUC1-18 cells which are a cleavage resistant single cell clone of HCT cells transfected with full-length MUC1, also referred to herein as HCT-MUC1-41TR, and cells were probed with antibody MNC2. FIG. 35D shows HCT-MUC1-18 cells probed with antibody VU4H5 which is an antibody that recognizes the hundreds of tandem repeats epitopes in full-length MUC1. As can be seen in the figures, MNC2 recognizes an ectopic epitope that is not accessible in full-length MUC1.

Figure 36B:
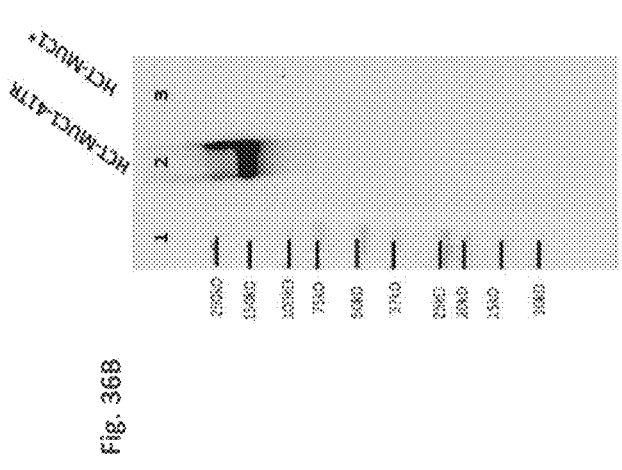
Figure 36D:
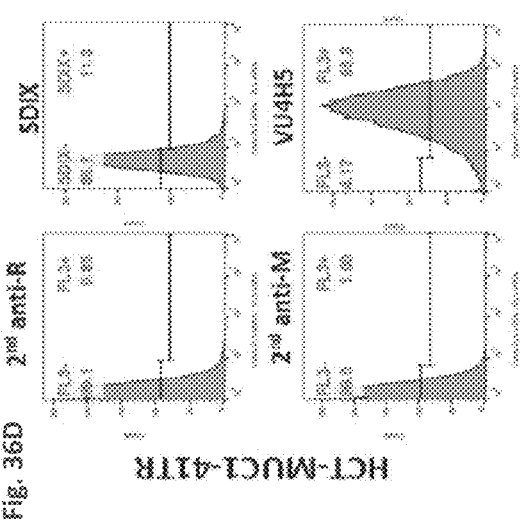
Figure 36A:
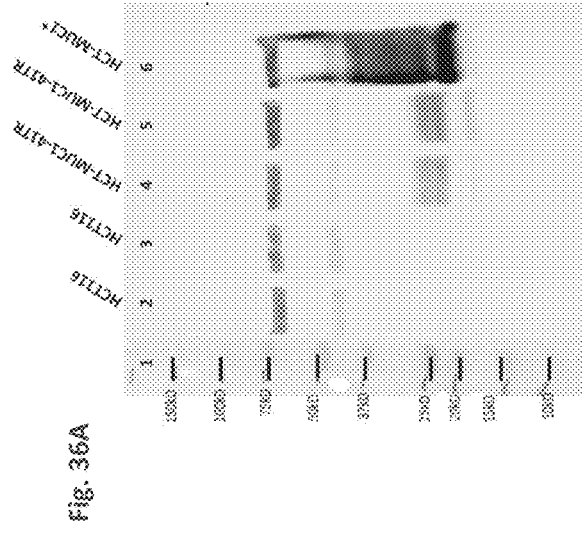
Figure 36C:
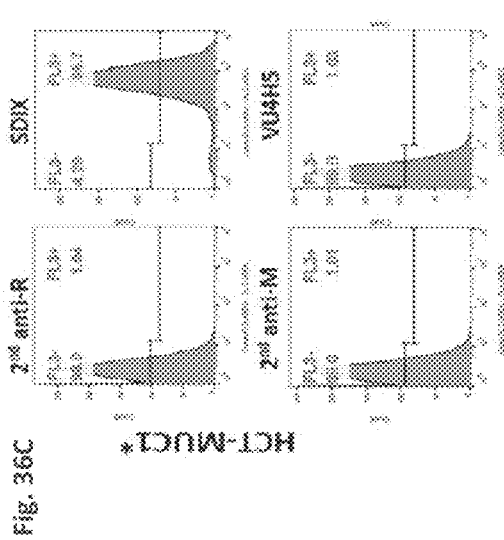

FIGS. 36A-36D show Western blots and corresponding FACs analysis of HCT-116 cells which are a MUC1 negative colon cancer cell line, that were then stably transfected with either MUC1* or MUC1 full-length. The single cell clones that are shown are HCT-MUC1-41TR, and HCT-MUC1*. FIG. 36A shows a Western blot of the parent cell line HCT-116, HCT-MUC1-41TR and HCT-MUC1* wherein the gel has been probed with a rabbit polyclonal antibody, SDIX, that only recognizes cleaved MUC1. A visible band between 25 and 35 kDa can be readily seen in Lane 6, loaded with HCT-MUC1*, whereas there is only a faint band in Lanes 4 and 5, showing that only a small amount of MUC1 is cleaved in the HCT-MUC1-41Tr cells. There is no cleaved MUC1 present in the parent cell line HCT-116 loaded into Lanes 2 and 3. FIG. 36B is a Western blot that was probed with a mouse monoclonal antibody VU4H5 that recognizes the tandem repeats of full-length MUC1. As can be seen, only HCT-MUC1-41TR contains full-length MUC1. FIG. 36C shows FACS scans showing that HCT-MUC1* is 95.7% positive for SDIX which only binds to MUC1* and essentially not at all for MUC1 full-length. FIG. 36D shows FACS scans that show that HCT-MUC1-41TR cells are 95% positive for full-length MUC1 and only about 11% positive for the cleaved form, MUC1*.

Figures 37A, 37B, 37C:
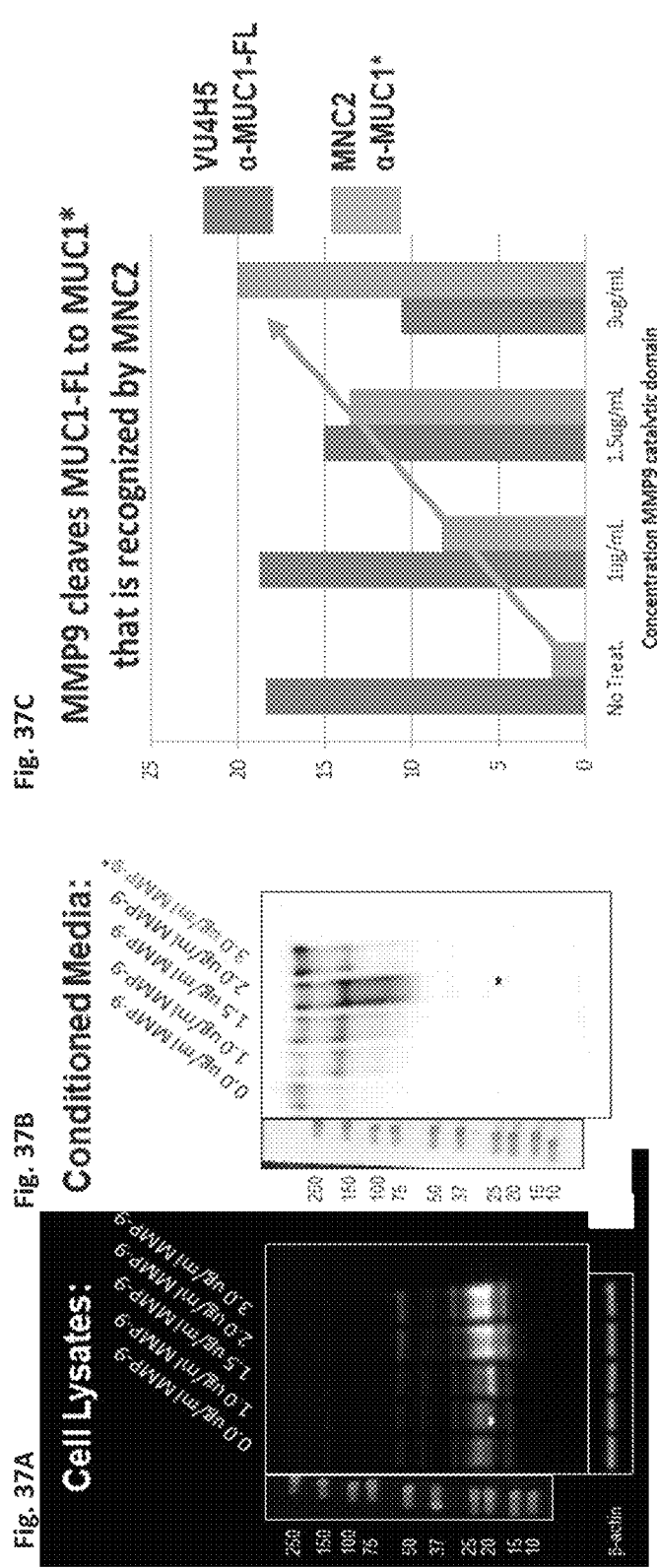

FIG. 37A-37C shows western blots and a bar graph of FACS analysis assessing the ability of MNC2 to recognize a full-length MUC1 after it has been cleaved by MMP9. FIG. 37A shows a Western blot of HCT-MUC1-18 cells, which are a cleavage resistant cell line, to which was added cleavage enzyme MMP9. The cell lysate fraction was run on a gel and probed with a polyclonal anti-PSMGFR antibody. The photo shows that in a dose dependent manner, MMP9 cleaved MUC1 to MUC1*, the ~25 kDa species. FIG. 37B shows the Western blot of the conditioned media from the same experiment. The photo shows that the addition of cleavage enzyme MMP9, in a dose dependent manner, increased the release of the tandem repeat domain into the conditioned media. FIG. 37C shows FACS analysis of the experiment. The graphs show that the addition of MMP9, in a dose dependent manner, increased recognition of the cleavage product by anti-MUC1* antibody MNC2 and decreased the recognition of the full-length MUC1 which contains the tandem repeat domain.

Figure 38:

FIG. 38 shows a photograph of a Western blot in which HCT-MUC1-18 cells, labeled here as HCT-18, a cleavage resistant single cell clone of HCT cells transfected with full-length MUC1, are treated with varying amounts of a catalytically active ADAM17 or MMP14. Shed MUC1 tandem repeat domain of full-length MUC1 is immunoprecipitated from the conditioned media, and run on a gel that is then probed with VU4H5 that binds to the tandem repeat epitopes. As can be seen, MMP14 also efficiently cleaves MUC1 full-length and sheds the tandem repeat containing extra cellular domain into the conditioned media. Cleavage enzyme ADAM17 did not cleave MUC1.

Figures 39A, 39B:
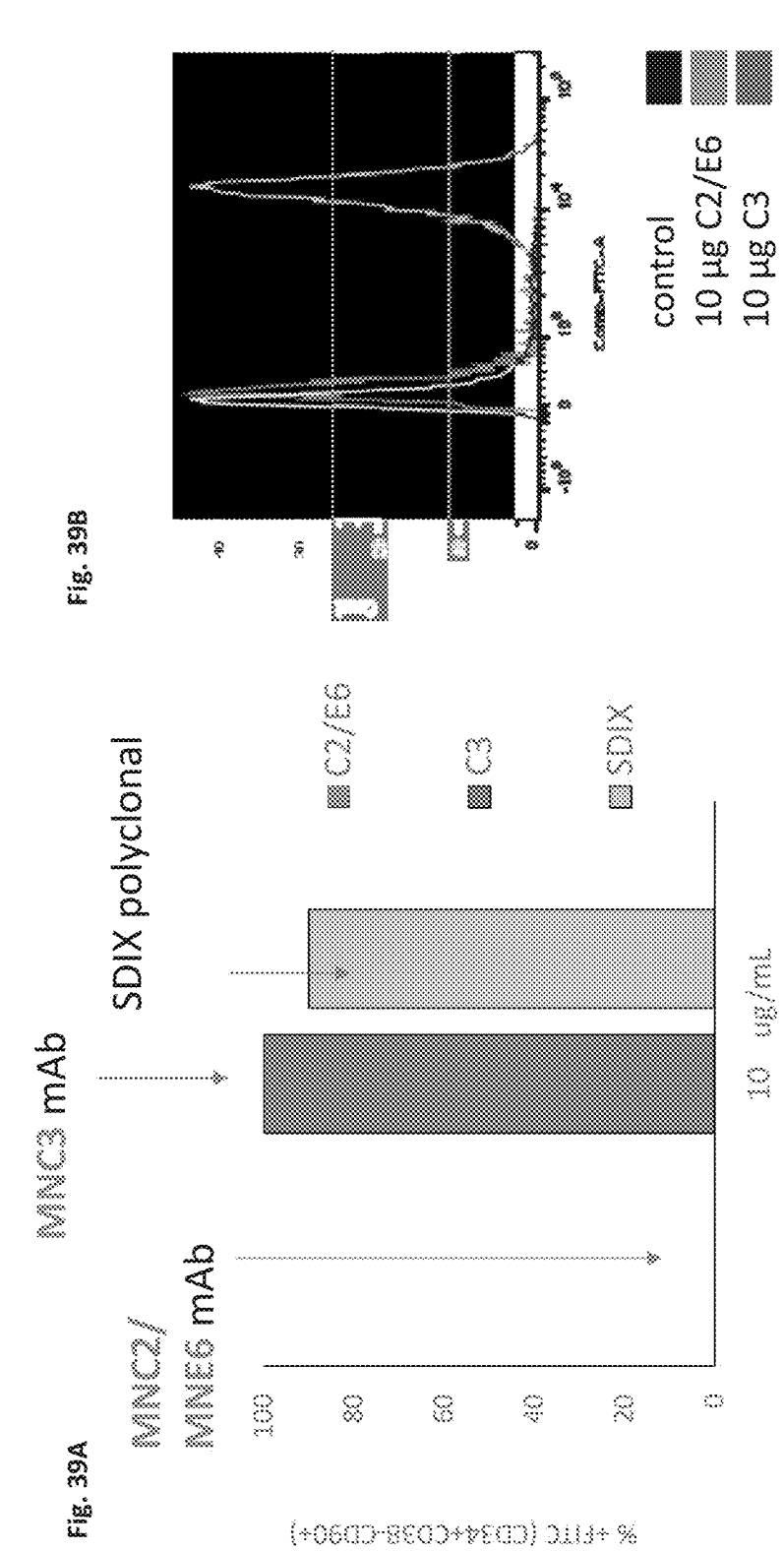

FIG. 39A-39B shows fluorescence activated cell sorting (FACS) measurements of human CD34+ hematopoietic stem cells of human bone marrow stained with anti-MUC1* monoclonal antibodies MNC3, MNC2, MNE6 or an isotype control antibody. The histogram of the FACS assay and the bar graph showing the data show that the MUC1* positive cells of the bone marrow are recognized by one anti-MUC1* antibody, MNC3 but not by MNE6 or MNC2. All three antibodies bind to the PSMGFR peptide. The great difference in the specificity of these antibodies suggests that MNC3 recognizes a MUC1*-like form created when MUC1 is cleaved by an enzyme that is different from MMP9.

Figures 40C, 40E, 40F, 40G:
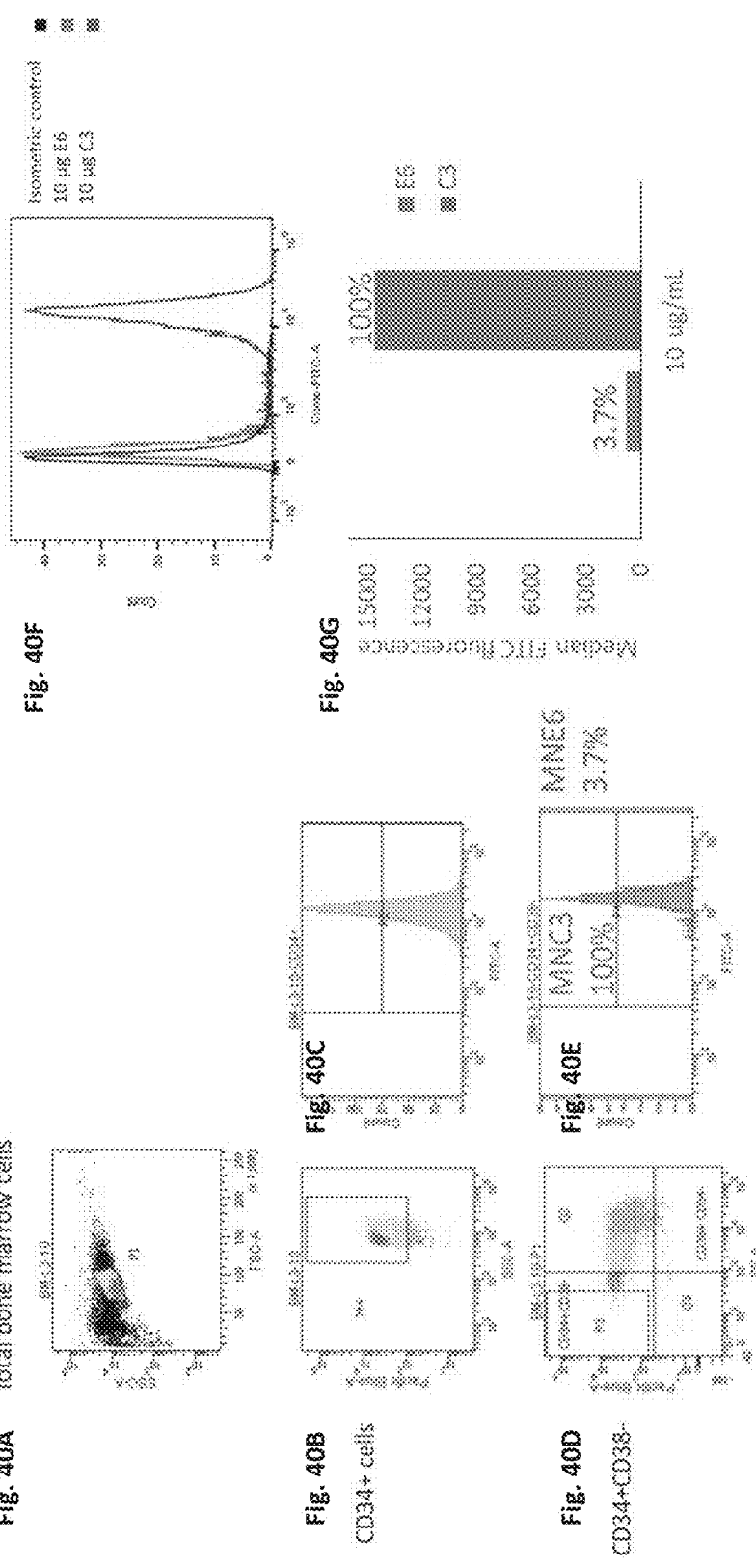
Figures 42A, 42B, 42C, 42D, 42E, 42F, 42G, 42H:
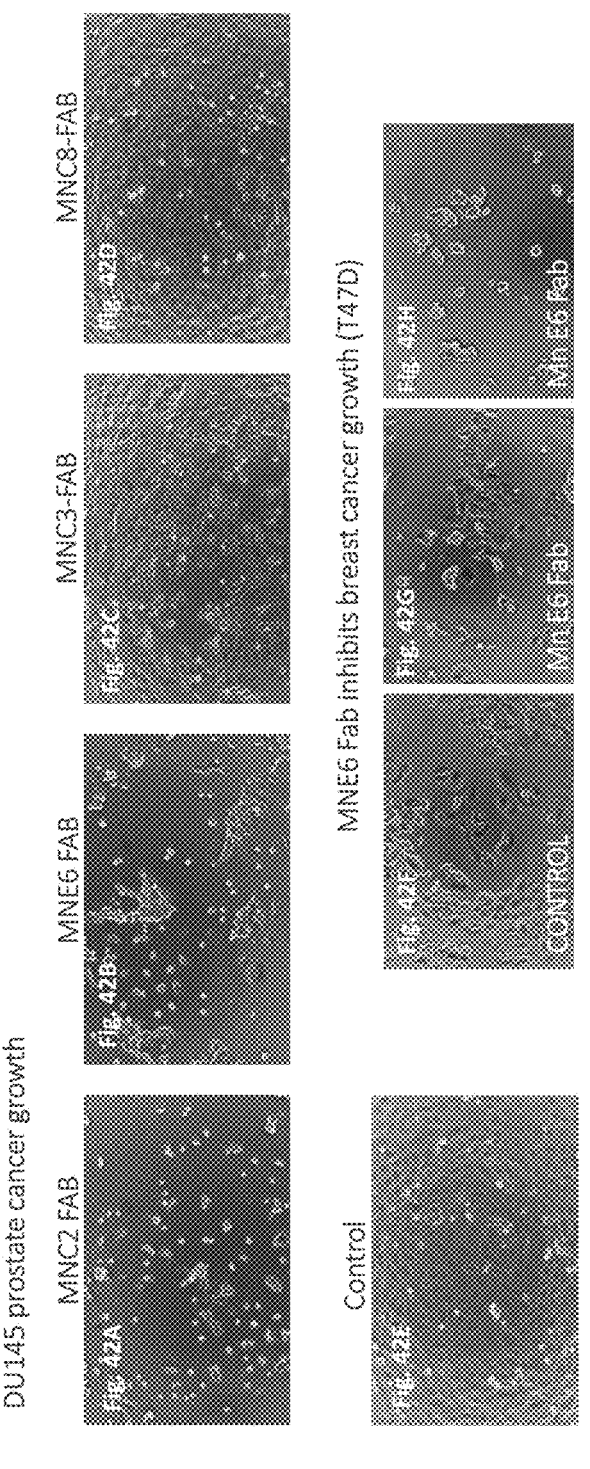

FIG. 40A-40G shows the details of FACS analysis of the hematopoietic stem cells probed with either MNC3 or MNE6. FIG. 40A shows the FACS scatter plot of total bone marrow cells. FIG. 40B shows the FACS scatter plot of the CD34+ cells. FIG. 40C shows the FACS histogram of the CD34+ cells. FIG. 40D shows the FACS scatter plot of the earliest hematopoietic stem cells, which are CD34+/CD38-, stained with either MNC3 or MNE6. FIG. 40E shows the histogram of the experiment. FIG. 40F shows the histogram overlay of MNC3 binding to CD34+/CD38-cells versus MNE6. FIG. 40G shows the bar graph of that FACS experiment.

FIG. 41A-42H shows the details of FACS analysis of CD34+/CD38$^{-/lo}$ hematopoietic stem cells probed with a polyclonal anti-PSMGFR antibody SDIX, MNE6 or MNC2. FIG. 41A shows the FACS scatter plot of the CD34+/CD38$^{-/lo}$ population of cells. FIG. 41E shows a table of the detailed analysis. FIG. 41B shows the FACS scatter plot of the CD34+/CD38$^{-/lo}$ population of cells probed with the anti-PSMGFR polyclonal antibody SDIX. FIG. 41F shows a table of the detailed analysis. FIG. 41C shows the FACS scatter plot of the CD34+/CD38$^{-/lo}$ population of cells probed with MNE6. FIG. 41G shows a table of the detailed analysis. FIG. 41D shows the FACS scatter plot of the CD34+/CD38$^{-/lo}$ population of cells probed with MNC2. FIG. 41H shows a table of the detailed analysis.

FIG. 42A-42H shows photographs of DU145 prostate cancer cells or T47D breast cancer cells that have been treated with either the Fab of anti-MUC1* antibody MNC2, MNE6, MNC3 or MNC8. The images show that cancer specific antibodies MNC2 and MNE6 effectively kill prostate and breast cancer cells while the monoclonal antibodies MNC3 and MNC8 do not.

Figure 43:
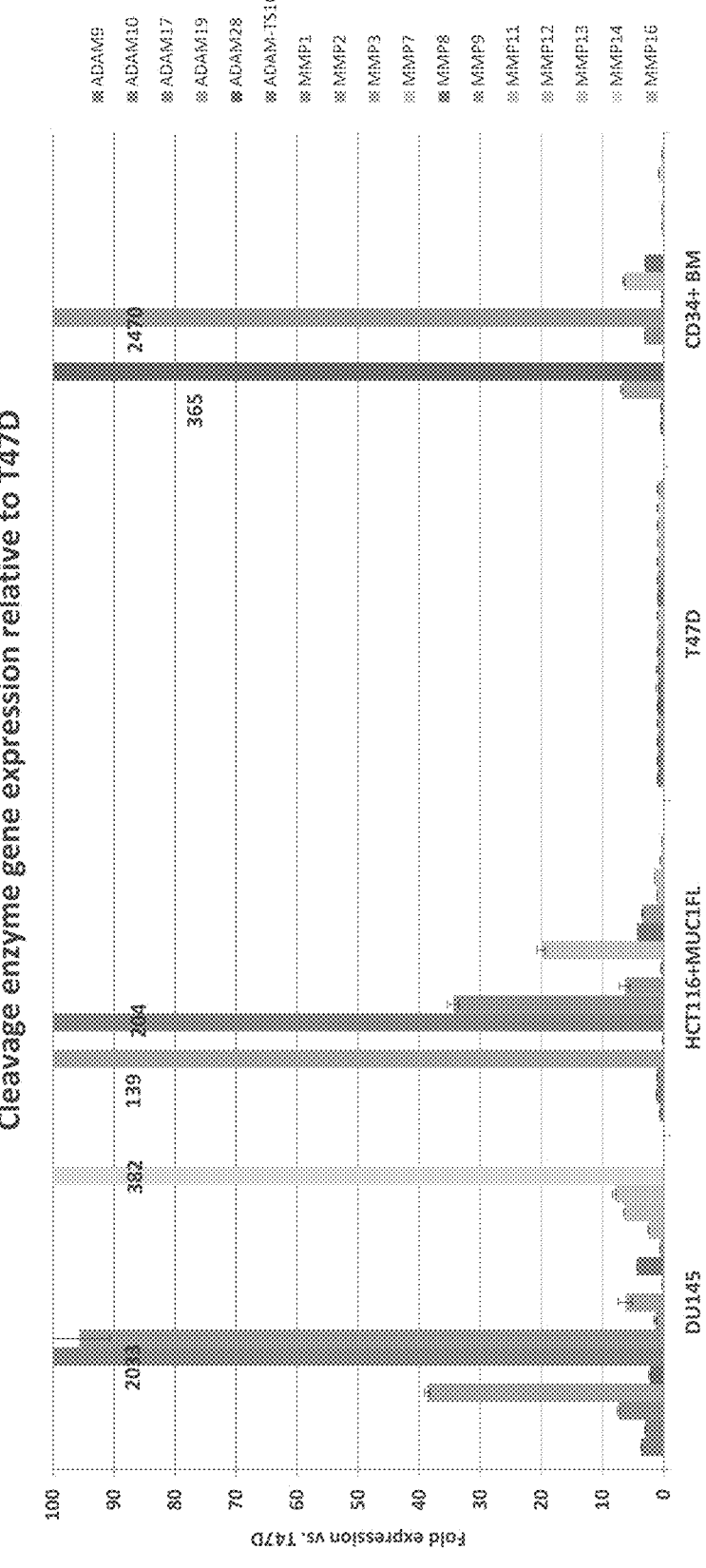

FIG. 43 shows a graph of a PCR experiment comparing expression of a wide range of cleavage enzymes expressed in different cells lines, wherein the values have been normalized to those expressed in breast cancer cell line T47D. Cell lines that are compared are prostate cancer cell line DU145, HCT-MUC1-41TR that is a MUC1 negative colon cancer cell line transfected with a MUC1 whose extracellular domain is truncated after 41 tandem repeat units and that is not cleaved to the MUC1* form, T47D breast cancer cell line and CD34+ bone marrow cells.

FIG. 43 shows a graph of a PCR experiment in which the expression levels of various cleavage enzymes are measured in DU145 prostate cancer cells, HCT116+MUC1FL, also known as HCT-MUC1-18 a cell line expressing full-length MUC1, T47D breast cancer cells, and CD34+ hematopoietic stem cells of the bone marrow. The fold expression is relative to the expression of each cleavage enzyme in T47D breast cancer cells, set as 1.

Figure 44:
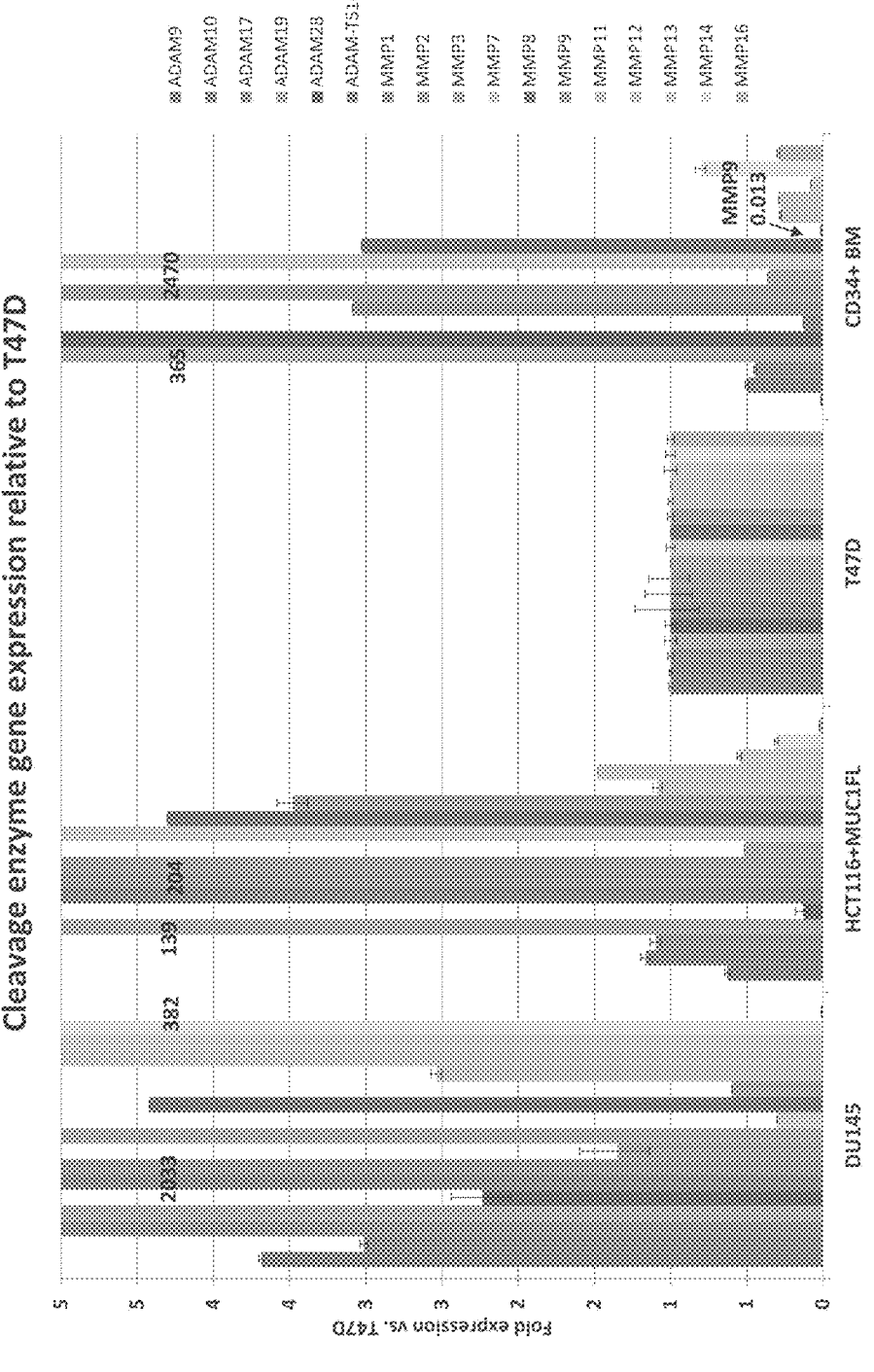

FIG. 44 shows the graph of the PCR experiment of FIG. 43 but with the Y-axis maximum set to 5.

Figures 45A, 45P:
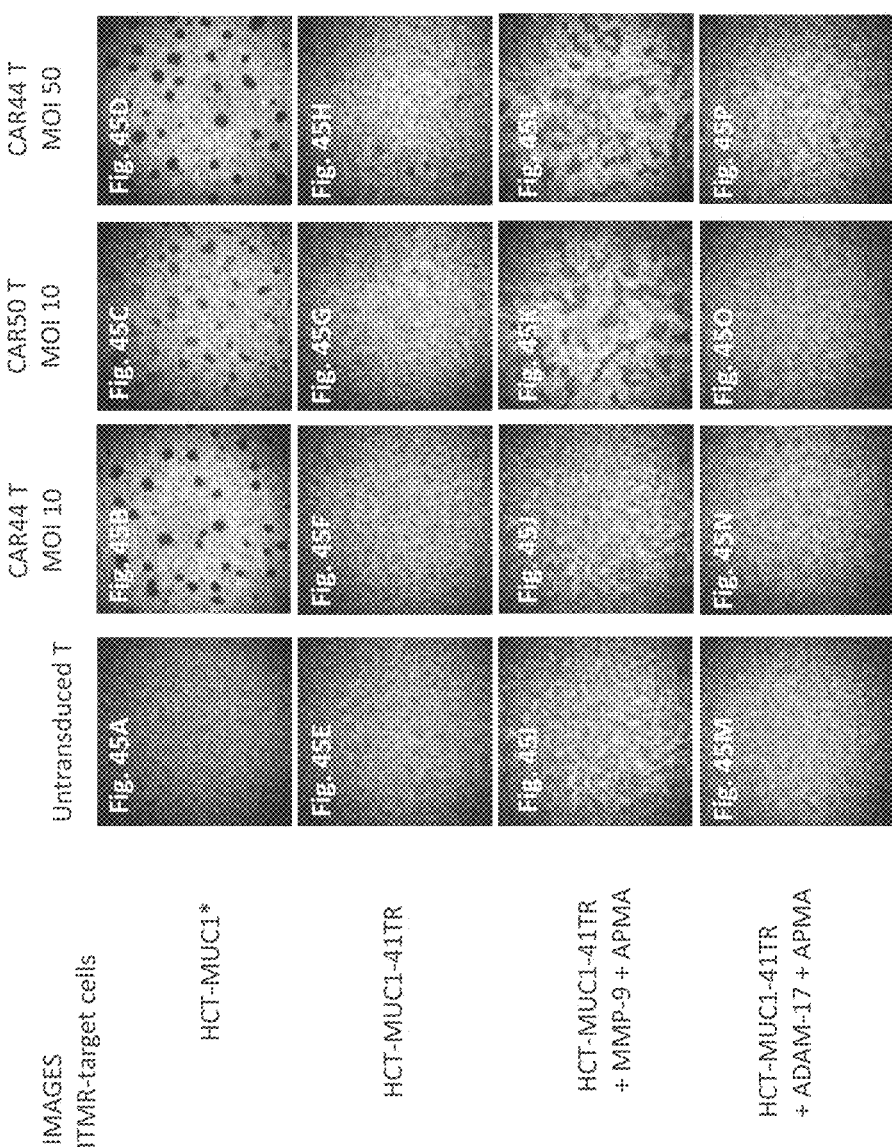

FIGS. 45A-45P show photographs of a CAR T co-culture assay in which the targeting antibody fragment of the CAR is huMNC2scFv wherein CAR44 has a CD8 transmembrane domain, followed by 41BB-3zeta and CAR50 has a CD4 transmembrane domain, followed by 41BB-3zeta. The target cancer cells are: HCT-FLR which is HCT-116 cells transfected with MUC1*$_{45}$ and HCT-MUC1-41TR, which is a stable single cell clone HCT-116 cell line that expresses MUC1 with an extracellular domain truncated after 41 tandem repeats and that does not get cleaved to the MUC1* form on its own. The HCT-MUC1-41TR cancer cells were also incubated with conditioned media from cells transfected with MMP9 or ADAM17 before co-culture with the CAR T cells. Conditioned media of the MMP9 or ADAM17 expressing cells were also incubated with APMA which is an activator of those cleavage enzymes. The images shown are an overlay of the 4× bright field image and the fluorescent image of the same showing cancer cells dyed with a red CMTMR lipophilic dye. FIGS. 45A, 45E, 45I, 45M show photographs of cells co-cultured with untransduced human T cells. FIGS. 45B, 45F, 45J, 45N show photographs of cells co-cultured with human T cells transduced with anti-MUC1* CAR44 at an MOI of 10. FIGS. 45C, 45G, 45K, 45O show photographs of cells co-cultured with human T cells transduced with anti-MUC1* CAR50 at an MOI of 10. FIGS. 45D, 45H, 45L, 45P show photographs of cells co-cultured with human T cells transduced with anti-MUC1* CAR44 at an MOI of 50, which increases transduction efficiency. FIGS. 45B, 45C, 45D show that both CAR44 and CAR50 transduced T cells recognized MUC1* expressed in these cancer cells, bound to them, induced clustering and killed many cancer cells. FIGS. 45F, 45G, 45H show that neither CAR44 nor CAR50 transduced T cells recognize full-length MUC1 expressed in HCT-MUC1-41TR cancer cells. There is no T cell induced clustering and the number of cancer cells has not decreased. FIGS. 45J, 45K, 45L show that activated MMP9 has cleaved full-length MUC1 to a MUC1* form that is recognized by both CAR44 and CAR50 transduced T cells. There is clearly visible CAR T cell induced clustering and a decrease in the number of cancer cells as they are killed. FIGS. 45N, 450, 45P show that activated ADAM17 has either not cleaved MUC1 or cleaved it at a position not recognized by MNC2. Neither huMNC2-CAR44 nor huMNC2-CAR50 transduced T cells recognized these cancer cells.

Figures 46A, 46T:
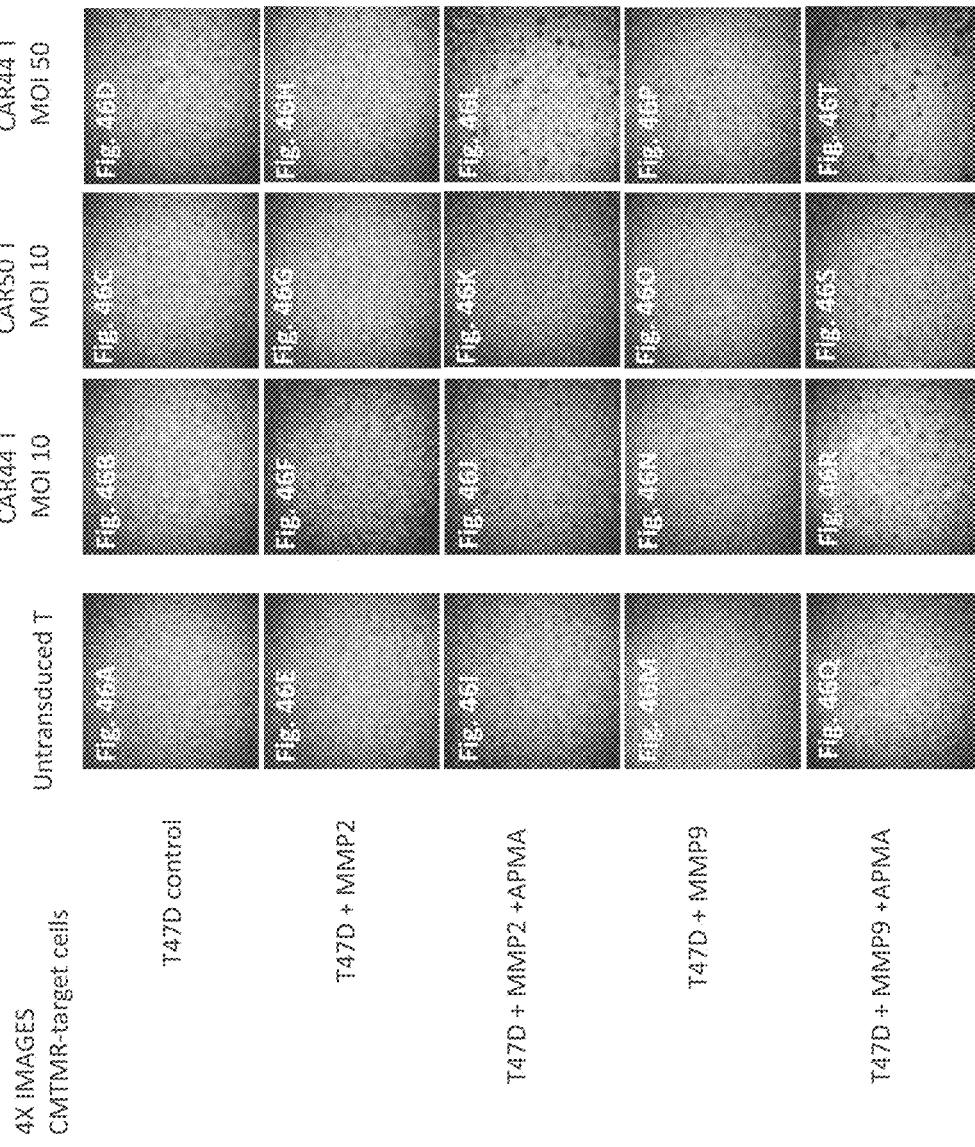

FIG. 46A-46T shows photographs of a CAR T co-culture assay in which the targeting antibody fragment of the CAR is MNC2 scFv wherein CAR44 has a CD8 transmembrane domain, followed by 41BB-3zeta and CAR50 has a CD4 transmembrane domain, followed by 41BB-3zeta. The target cancer cells are breast cancer T47D cells that were also incubated with conditioned media from cells transfected with MMP2, MMP9 or ADAM17 before co-culture with the MNC2-CAR T cells. In some cases, the conditioned media of the MMP2 and MMP9 expressing cells were also incubated with APMA, which is an activator of these cleavage enzymes. The images shown are an overlay of the 4× bright field image and the fluorescent image of the same showing cancer cells dyed with a red CMTMR lipophilic dye. As can be seen, the MNC2-CAR T cells only bind to and attack the target cancer cells that express the cleaved form, MUC1*.

Figures 47A, 47B, 47C, 47D, 47E, 47F, 47G, 47H, 47I:
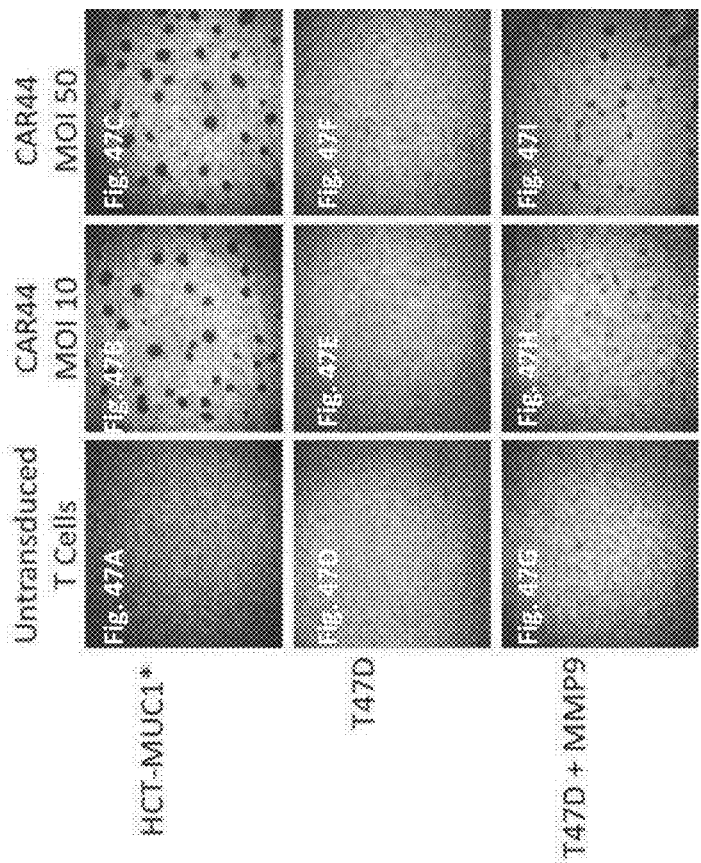

FIGS. 47A-47I show photographs of cancer cells co-cultured with anti-MUC1* CAR T cells, wherein some of the cancer cells were pre-incubated with activated MMP9 prior to co-culture with the CAR T cells. The cancer cells shown in FIGS. 47A-47C are MUC1 negative colon cancer cell line HCT-116 that have been stably transfected to express MUC1*. The cancer cells shown in FIGS. 47D-47F are MUC1 positive breast cancer cell line T47Ds that express high levels of both MUC1 full-length and MUC1*. The cancer cells shown in FIGS. 47G-47I are MUC1 positive breast cancer cell line T47Ds that were pre-incubated with activated MMP9. The cells shown in FIGS. 47A, 47D and 47G were co-cultured with untransduced human T cells and are the controls. The cells shown in FIGS. 47B, 47E and 47H were co-cultured with human T cells that were transduced with huMNC2-CAR44 at an MOI of 10, wherein MOI stands for multiplicity of infection and the higher the MOI the more CARs are expressed on the T cells. The cells shown in FIGS. 47C, 47F and 47I were co-cultured with human T cells that were transduced with huMNC2-CAR44 at an MOI of 50. As can be seen in the photographs, the CAR44 T cells bind to the target MUC1* positive cancer cells, surrounding and killing them. Comparing the photograph FIG. 47I with the others, it can be seen that the cells that were pre-incubated with MMP9 become much more susceptible to CAR T killing when the antibody targeting head of the CAR recognizes MUC1*. It also demonstrates that MUC1 cleaved by MMP9 is recognized by huMNC2scFv.

Figure 48:
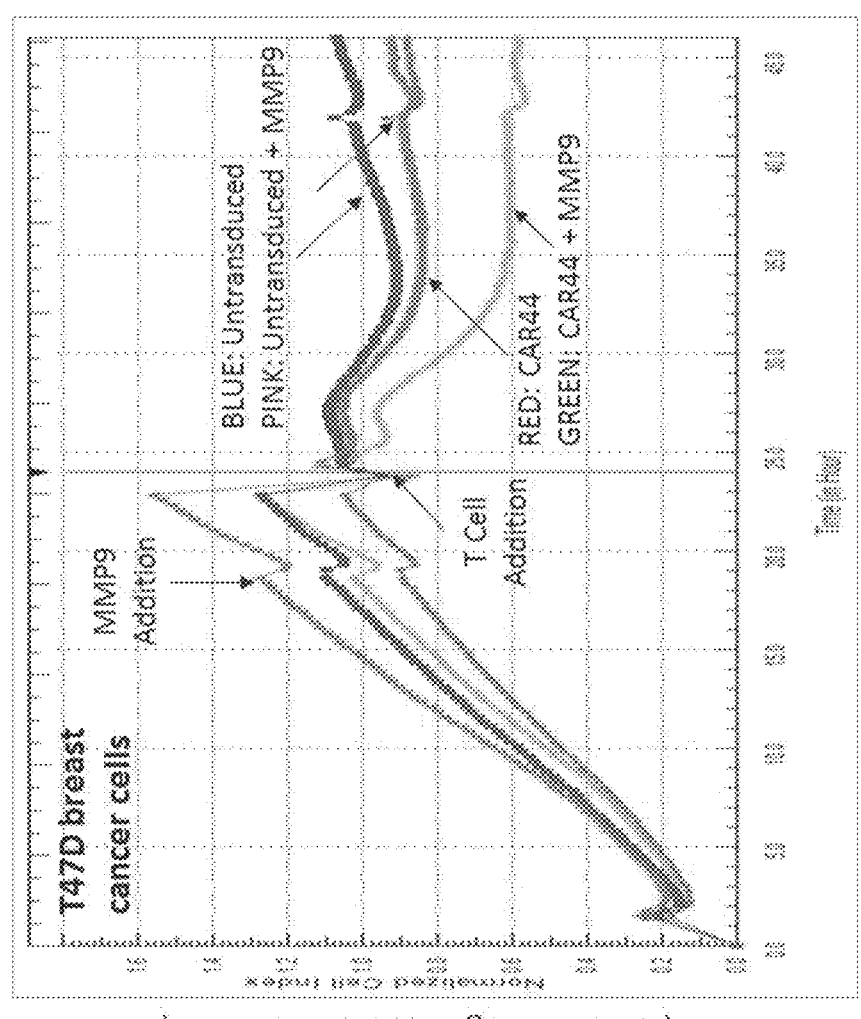

FIG. 48 shows an xCelligence graph of T47D breast cancer cells in co-culture with either untransduced T cells, as a control, or huMNC2-CAR44 T cells over a 45 hour period. After 18 hours of cancer cell growth, a catalytic sub-unit MMP9 was added to some of the cells. At 25 hours, T cells were added. As can be seen, huMNC2-CAR44 T cell killing is greatly improved when the T47D cells are pre-incubated with cleavage enzyme MMP9. In the xCelligence system, target cancer cells, which are adherent, are plated onto electrode array plates. Adherent cells insulate the electrode and increase the impedance. The number of adherent cancer cells is directly proportional to impedance. T cells are not adherent and do not contribute to impedance. Therefore, increasing impedance reflects growth of cancer cells and decreasing impedance reflects killing of cancer cells.

Figure 49:
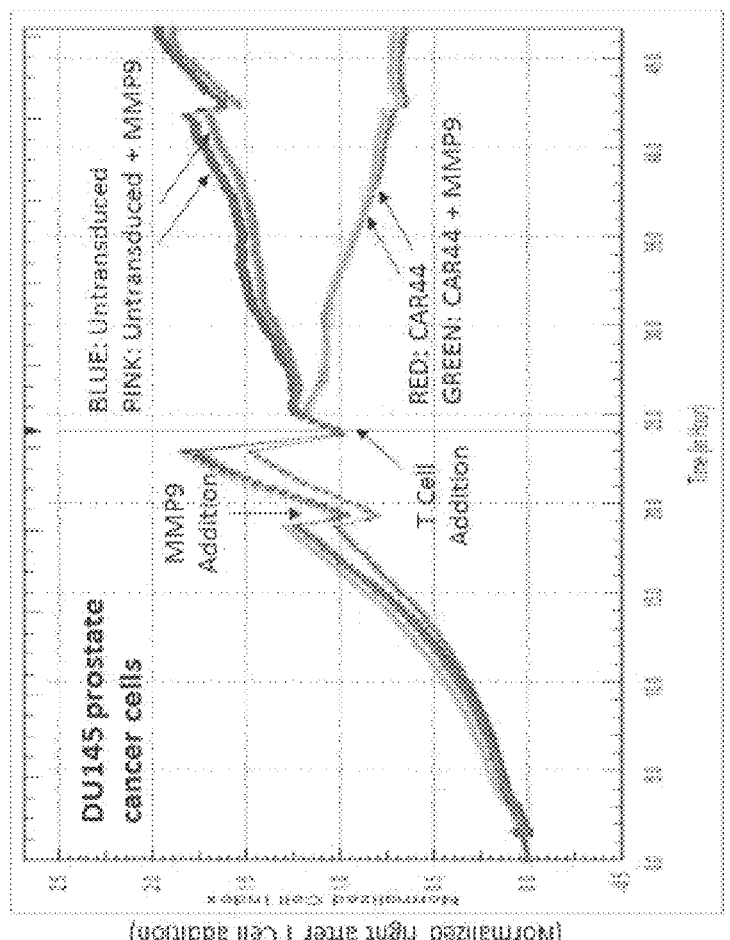

FIG. 49 shows an xCelligence graph of DU145 prostate cancer cells in co-culture with either untransduced T cells, as a control, or huMNC2-CAR44 T cells over a 45 hour period. After 18 hours of cancer cell growth, a catalytic sub-unit MMP9 was added to some of the cells. At 25 hours, T cells were added. As can be seen, huMNC2-CAR44 T cell killing is not affected by pre-incubation with cleavage enzyme MMP9. DU145 cancer cells express a significantly lower amount of MUC1 which includes the full-length form as well as MUC1*. The lower density of MUC1 full-length does not sterically hinder T cell access to the membrane proximal MUC1*.

Figure 50:
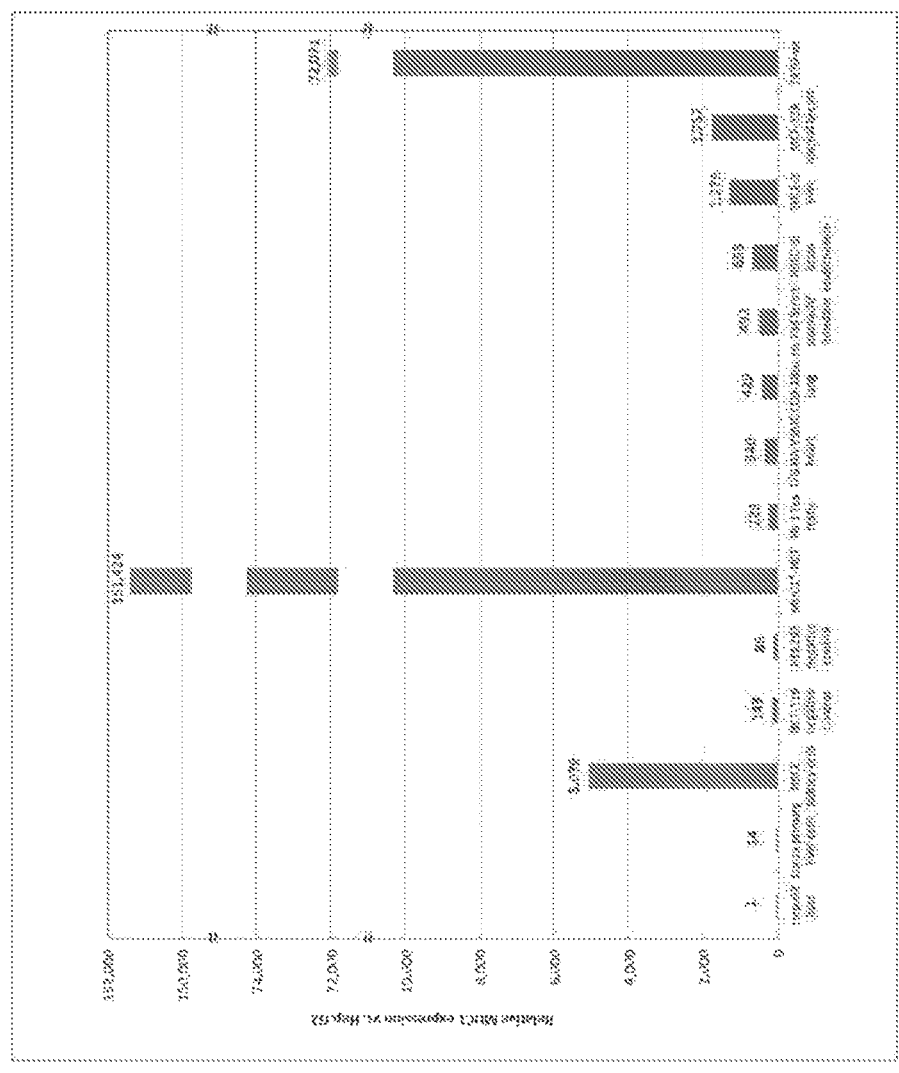

FIG. 50 shows a bar graph of a PCR experiment measuring the amount of MUC1 expressed by a panel of cell lines and primary cells, comprised of normal cells as well as cancer cells. PCR measurement of MUC1 expression in normal cells was compared to T47D breast cancer cells and HCT-MUC1*, a colon cancer cell line transduced with MUC1*. Measurement was normalized to Hep. G2, MUC1 negative normal liver cells.

Figures 51A, 51B:
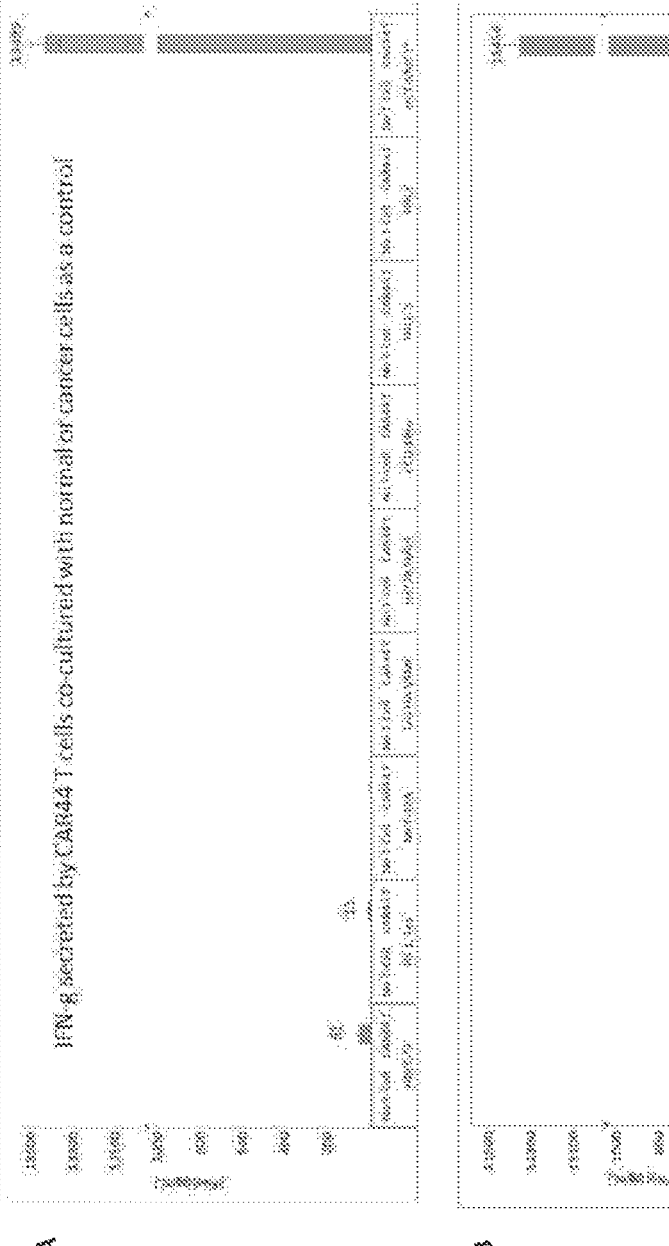

To assess CAR44 T cell activation in response to co-culture with target cells, IFN-g was measured in supernatant of CAR44 T cells in co-culture with normal cells, or cancer cells as a control. FIG. 51A-51B shows a bar graph of an ELISA assay measuring the amount of interferon gamma, IFN-g, secreted by huMNC2-CAR44 human T cells after co-culture with the normal cells or the HCT-MUC1* cancer cells for 72 hours. FIG. 51A shows the results of the experiment where the CAR44 T cell to target cell ratio was 1:1. FIG. 51B shows the results of the experiment where the CAR44 T cell to target cell ratio was 0.5:1.

Figures 52A, 52B:
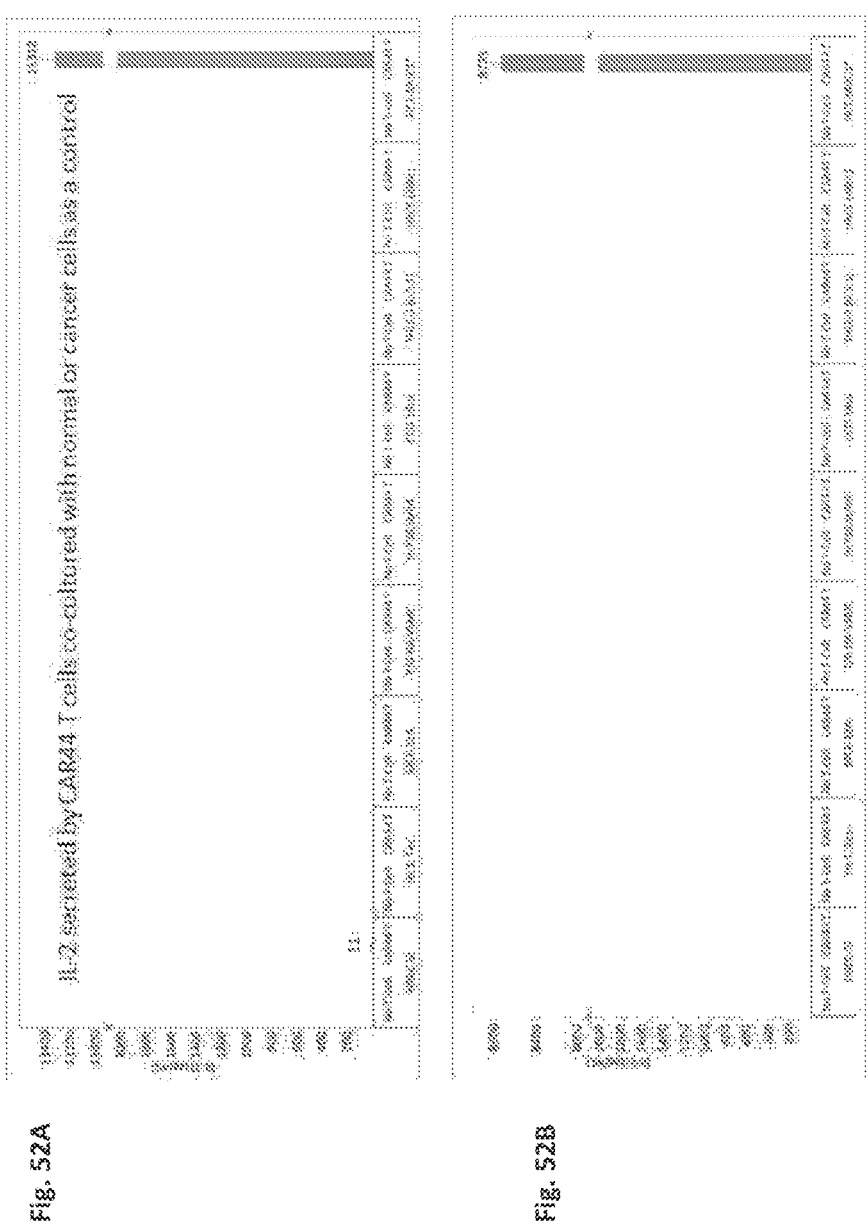

To assess CAR44 T cell activation in response to co-culture with target cells, IL-2 was measured in supernatant of CAR44 T cells in co-culture with normal cells, or cancer cells as a control. FIG. 52A-52B shows a bar graph of an ELISA assay measuring the amount of interleukin-2, IL-2, secreted by huMNC2-CAR44 human T cells after co-culture with the normal cells or the HCT-MUC1* cancer cells for 72 hours. FIG. 52A shows the results of the experiment where the CAR44 T cell to target cell ratio was 1:1. FIG. 52B shows the results of the experiment where the CAR44 T cell to target cell ratio was 0.5:1.

FIG. 53A-53J shows bar graphs of FACS analysis of live versus dead markers and photographs of normal cells versus cancer cells after co-culture with huMNC2-CAR44 T cells. (Left) Normal cells, or cancer cells as a control, were co-culture with no T cells, Untransduced T cells or with CAR44 T cells, at an ET ratio of 1:1 or 0.5:1. Cells were then labeled with a cell death marker and analyzed by FACS. The CD3+ population (T cells) was eliminated from the cell count. A-F (Center) & (Right) Magnified photographs of normal cells in co-culture with Untransduced T cells or CAR44 T cells. FACS and magnified photographs were at 48 hours post addition of T cells. FIG. 53A.1 shows the bar graph of FACS analysis of live versus dead cells after HCT-MUC1* cancer cells were co-cultured with huMNC2-

CAR44 T cells. FIG. 53A.2 and FIG. 53A.3 show the photographs of the experiment described in FIG. 53A.1. FIG. 53B.1 shows the bar graph of FACS analysis of live versus dead cells after MCF-12A normal breast cells were co-cultured with huMNC2-CAR44 T cells. FIG. 53B.2 and FIG. 53B.3 show the photographs of the experiment described in FIG. 53B.1. FIG. 53C.1 shows the bar graph of FACS analysis of live versus dead cells after THLE-3 normal liver cells were co-cultured with huMNC2-CAR44 T cells. FIG. 53C.2 and FIG. 53C.3 show the photographs of the experiment described in FIG. 53C.1.

FIG. 53D.1 shows the bar graph of FACS analysis of live versus dead cells after T/G HA-HSMC normal heart cells were co-cultured with huMNC2-CAR44 T cells. FIG. 53D.2 and FIG. 53D.3 show the photographs of the experiment described in FIG. 53D.1. FIG. 53E.1 shows the bar graph of FACS analysis of live versus dead cells after Hs1. Tes normal testes cells were co-cultured with huMNC2-CAR44 T cells. FIG. 53E.2 and FIG. 53E.3 show the photographs of the experiment described in FIG. 53E.1. FIG. 53F.1 shows the bar graph of FACS analysis of live versus dead cells after HEK-293 MUC1 negative cells were co-cultured with huMNC2-CAR44 T cells. FIG. 53F.2 and FIG. 53F.3 show the photographs of the experiment described in FIG. 53F.1. FIG. 53G.1 shows the bar graph of FACS analysis of live versus dead cells after HRCE normal kidney cells were co-cultured with huMNC2-CAR44 T cells. FIG. 53G.2 and FIG. 53G.3 show the photographs of the experiment described in FIG. 53G.1. FIG. 53H.1 shows the bar graph of FACS analysis of live versus dead cells after CCD-18Lu normal lung cells were co-cultured with huMNC2-CAR44 T cells. FIG. 53H.2 and FIG. 53H.3 show the photographs of the experiment described in FIG. 53H.1. FIG. 53I.1 shows the bar graph of FACS analysis of live versus dead cells after HBEC-5i normal brain cells were co-cultured with huMNC2-CAR44 T cells. FIG. 53I.2 and FIG. 53I.3 show the photographs of the experiment described in FIG. 53I.1. FIG. 53J.1 shows the bar graph of FACS analysis of live versus dead cells after Hs.738.St/Int normal stomach and intestine cells were co-cultured with huMNC2-CAR44 T cells. FIG. 53J.2 and FIG. 53J.3 show the photographs of the experiment described in FIG. 53J.1.

Figure 54:
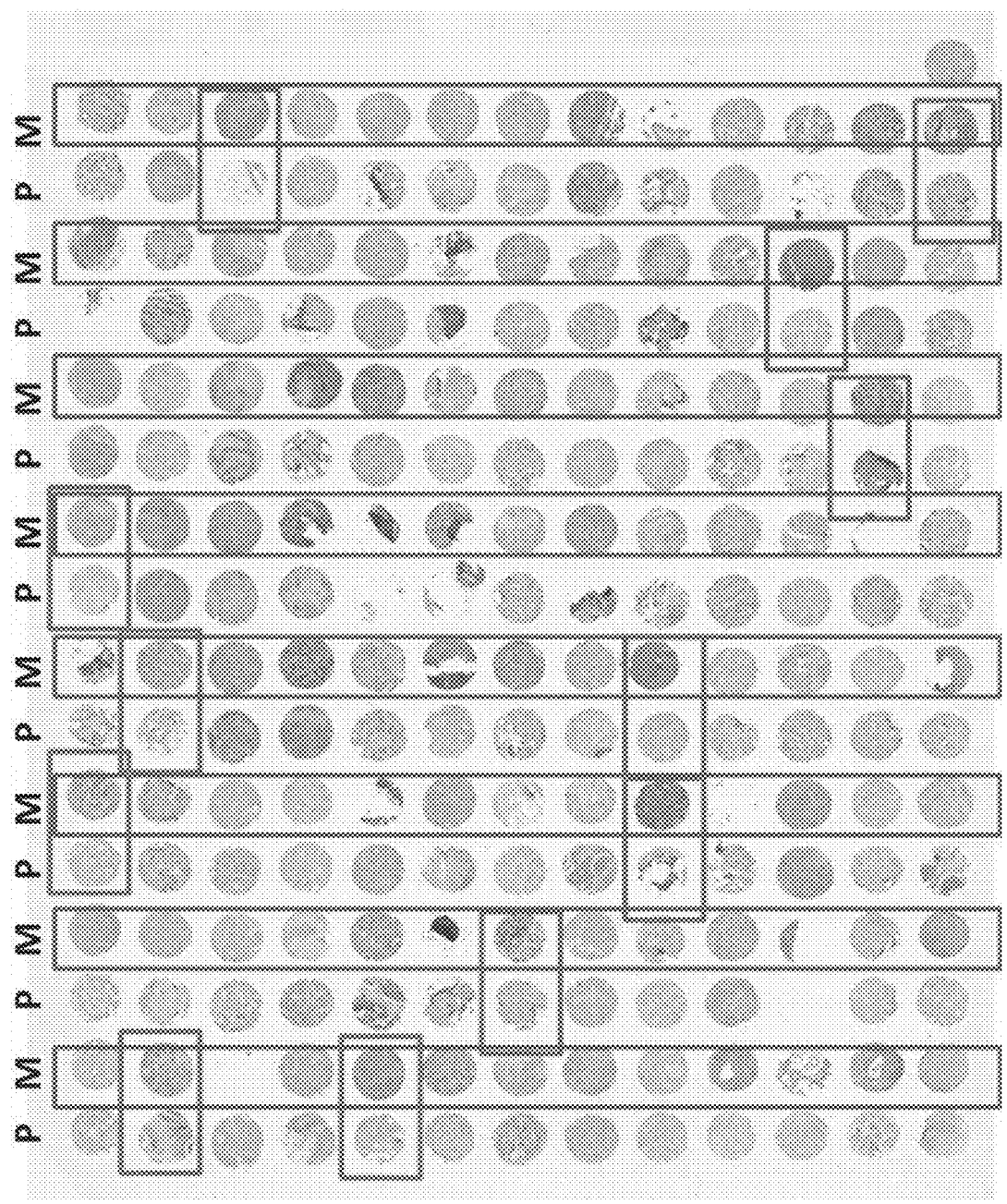

FIG. 54 shows photographs of a breast cancer tissue array (CB-insert array number) in which for each patient there is a specimen from the primary tumor plus a specimen from that patient's metastasis. As can be seen in the figure, most often the metastasis expresses more MUC1* than the primary tumor.

FIGS. 55A-55H show the cytotoxic effect of huMNC2-CAR44 T cells on MUC1* positive DU145 prostate cancer cells as measured by a variety of assays. FIG. 55A is a fluorescent photograph of untransduced T cells co-cultured with the prostate cancer cells, wherein granzyme B is stained with a red fluorophore. FIG. 55B shows merging of DAPI and granzyme B. FIG. 55C is a fluorescent photograph of huMNC2-CAR44 T cells co-cultured with the prostate cancer cells, wherein granzyme B is stained with a red fluorophore. FIG. 55D shows merging of DAPI and granzyme B. FIG. 55E is a FACS scan for fluorescently labeled granzyme B for untransduced T cells incubated with the cancer cells. FIG. 55F is a FACS scan showing a positive increase in fluorescently labeled granzyme B for huMNC2-CAR44 T cells incubated with the cancer cells. FIG. 55G is a graph of the mean fluorescent intensity. FIG. 55H is an xCELLigence scan tracking the real-time killing of DU145 cancer cells by huMNC2-CAR44 T cells (blue trace) but not by untransduced T cells (green).

FIGS. 56A-56H show the cytotoxic effect of huMNC2-CAR44 T cells on MUC1* positive CAPAN-2 pancreatic cancer cells as measured by a variety of assays. FIG. 56A is a fluorescent photograph of untransduced T cells co-cultured with the pancreatic cancer cells, wherein granzyme B is stained with a red fluorophore. FIG. 56B shows merging of DAPI and granzyme B. FIG. 56C is a fluorescent photograph of huMNC2-CAR44 T cells co-cultured with the pancreatic cancer cells, wherein granzyme B is stained with a red fluorophore. FIG. 56D shows merging of DAPI and granzyme B. FIG. 56E is a FACS scan for fluorescently labeled granzyme B for untransduced T cells incubated with the cancer cells. FIG. 56F is a FACS scan showing a positive increase in fluorescently labeled granzyme B for huMNC2-CAR44 T cells incubated with the cancer cells. FIG. 56G is a graph of the mean fluorescent intensity. FIG. 56H is an xCELLigence scan tracking the real-time killing of CAPAN-2 cancer cells by huMNC2-CAR44 T cells (blue trace) but not by untransduced T cells (green).

Figure 57B:
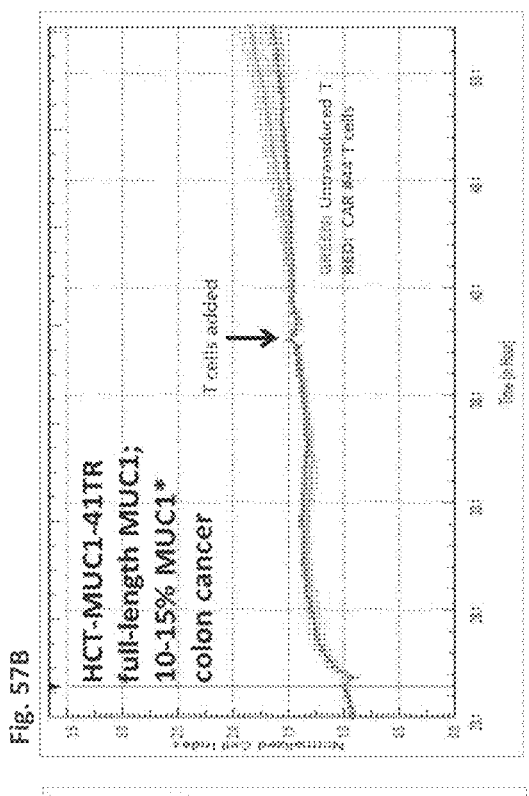
Figure 57A:
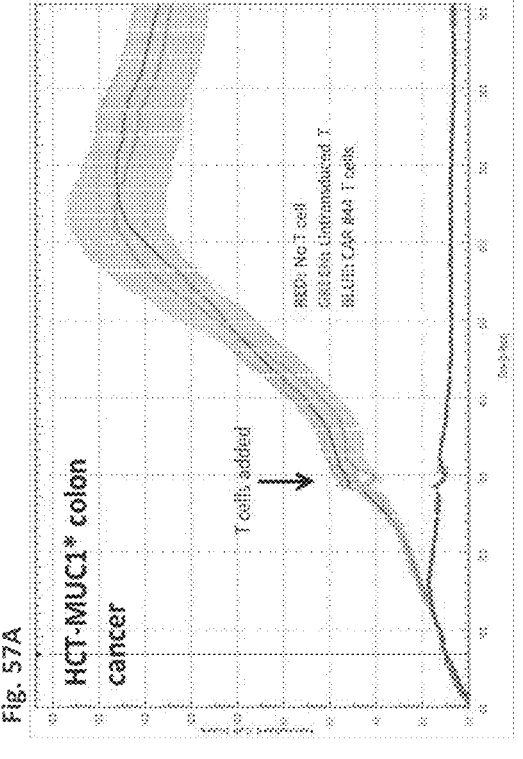
Figure 57C:
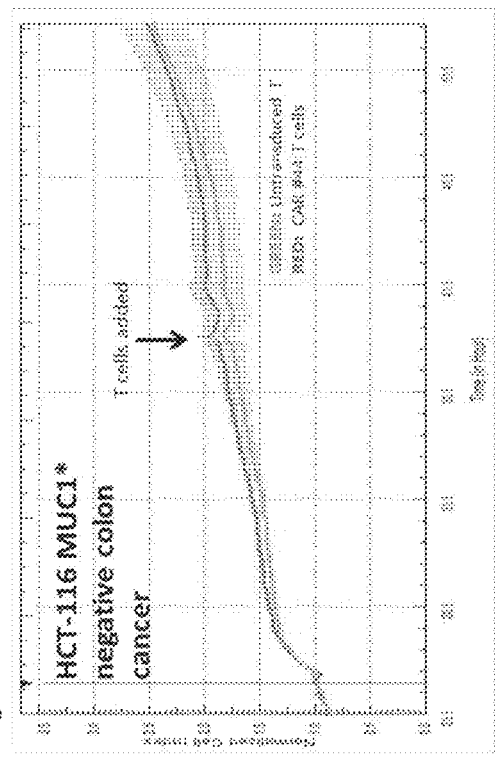

FIGS. 57A-57C show xCELLigence scans tracking the real-time killing of MUC1* positive cancer cells, but not MUC1* negative cells, by huMNC2-CAR44 T cells. FIG. 57A shows that huMNC2-CAR44 T cells effectively kill HCT colon cancer cells that have been stably transfected with MUC1*. FIG. 57B shows that huMNC2-CAR44 T cells have almost no effect on HCT-MUC1-41TR, which is a MUC1 negative cancer cell that has been stably transfected with a MUC1 full-length. In this cell line only about 10% of the cells have MUC1 cleaved to MUC1*. FIG. 57C shows that huMNC2-CAR44 T cells have no effect on HCT-116 cells, which is a MUC1 negative colon cancer cell line.

FIG. 58A-58F shows photographs NOD/SCID/GAMMA mice in an IVIS instrument measuring photon emission from tumor cells after mice were treated with nothing, PBS, untransduced human T cells or huMNC2-CAR44 T cells. Mice had been injected sub-cutaneously with HCT-MUC1* tumor cells that had been made Luciferase positive. Ten (10) minutes before the IVIS photographs were taken, the mice were injected into the intraperitoneal (ip) space with the Luciferase substrate, Luciferin. FIG. 58A shows the tumor bearing mice that had only been treated with phosphate buffered saline, PBS. FIG. 58B shows the tumor bearing mice that had only been treated with untransduced T cells. FIG. 58C shows the tumor bearing mice that had been treated with a single dose of huMNC2-CAR44 T cells. FIG. 58D shows color scale of the images. FIG. 58E shows Kaplan-Meier survival curves of the experiment. FIG. 58F shows a table detailing the molecular makeup of the human T cells that were isolated from the mouse blood after sacrifice.

FIG. 59A-59C shows photographs NOD/SCID/GAMMA mice in an IVIS instrument measuring photon emission from tumor cells after mice were treated with nothing, PBS or huMNC2-CAR44 T cells. Mice had been injected sub-cutaneously with T47D-wt breast cancer cells or T47D+ more MUC1*, which is a mixed population of cells wherein 95% of the cells were T47D cells that had been stably transfected with even more MUC1*. Both T47D-wt and T47D plus more MUC1* cells had been made Luciferase positive. Ten (10) minutes before the IVIS photographs were taken, the mice were injected into the intraperitoneal (ip) space with the Luciferase substrate, Luciferin. FIG. 59A shows the tumor bearing mice that had only been treated with phosphate buffered saline, PBS. FIG. 59B shows the T47D-wt tumor bearing mice that had been treated with two (2) doses of huMNC2-CAR44 T cells. FIG. T90.1C shows the T47D-MUC1* tumor bearing mice that had been treated with two (2) doses of huMNC2-CAR44 T cells. T47D-wt is a naturally occurring metastatic breast cancer cell line. T47D+more MUC1* is that same cell line but with 95% of the tumor cells engineered to express more MUC1*. These results show that killing increases as MUC1* expression increases. MUC1* expression increases with tumor stage & acquired resistance to chemo drugs.

Figures 60A, 60B, 60C:
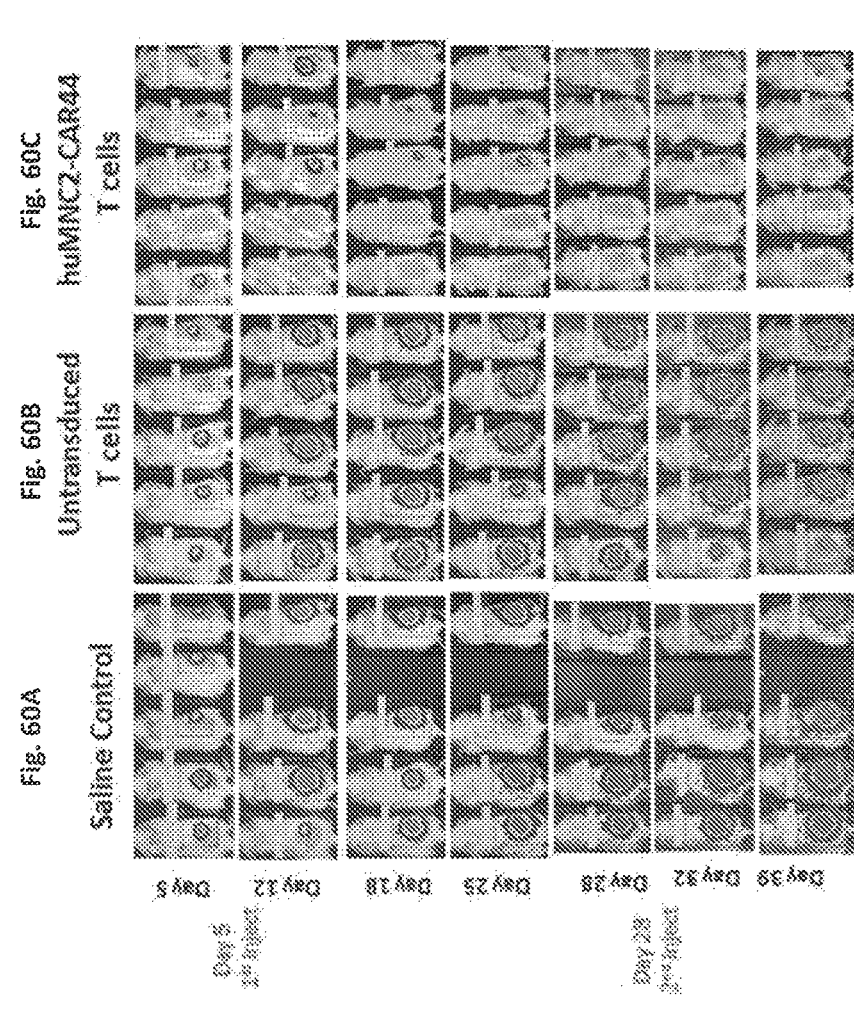

FIG. 60A-60C shows photographs NOD/SCID/GAMMA mice in an IVIS instrument measuring photon emission from tumor cells after mice were treated with nothing, PBS, untransduced T cells or huMNC2-CAR44 T cells. Mice had been injected sub-cutaneously with a mixed population of 70% T47D-wt breast cancer cells and 30% T47D cells that had been transfected with even more MUC1*. The resulting tumors mimic mid-stage tumors. Both cell types had been made Luciferase positive. Ten (10) minutes before the IVIS photographs were taken, the mice were injected into the intraperitoneal (ip) space with the Luciferase substrate, Luciferin. FIG. 60A shows the tumor bearing mice that had only been treated with phosphate buffered saline, PBS. FIG. 60B shows tumor bearing mice that had only been treated with untransduced T cells. FIG. 60C shows the tumor bearing mice that had been treated with two (2) doses of huMNC2-CAR44 T cells.

Figures 61A, 61B, 61C, 61D, 61E, 61F, 61G, 61H, 61I, 61J:
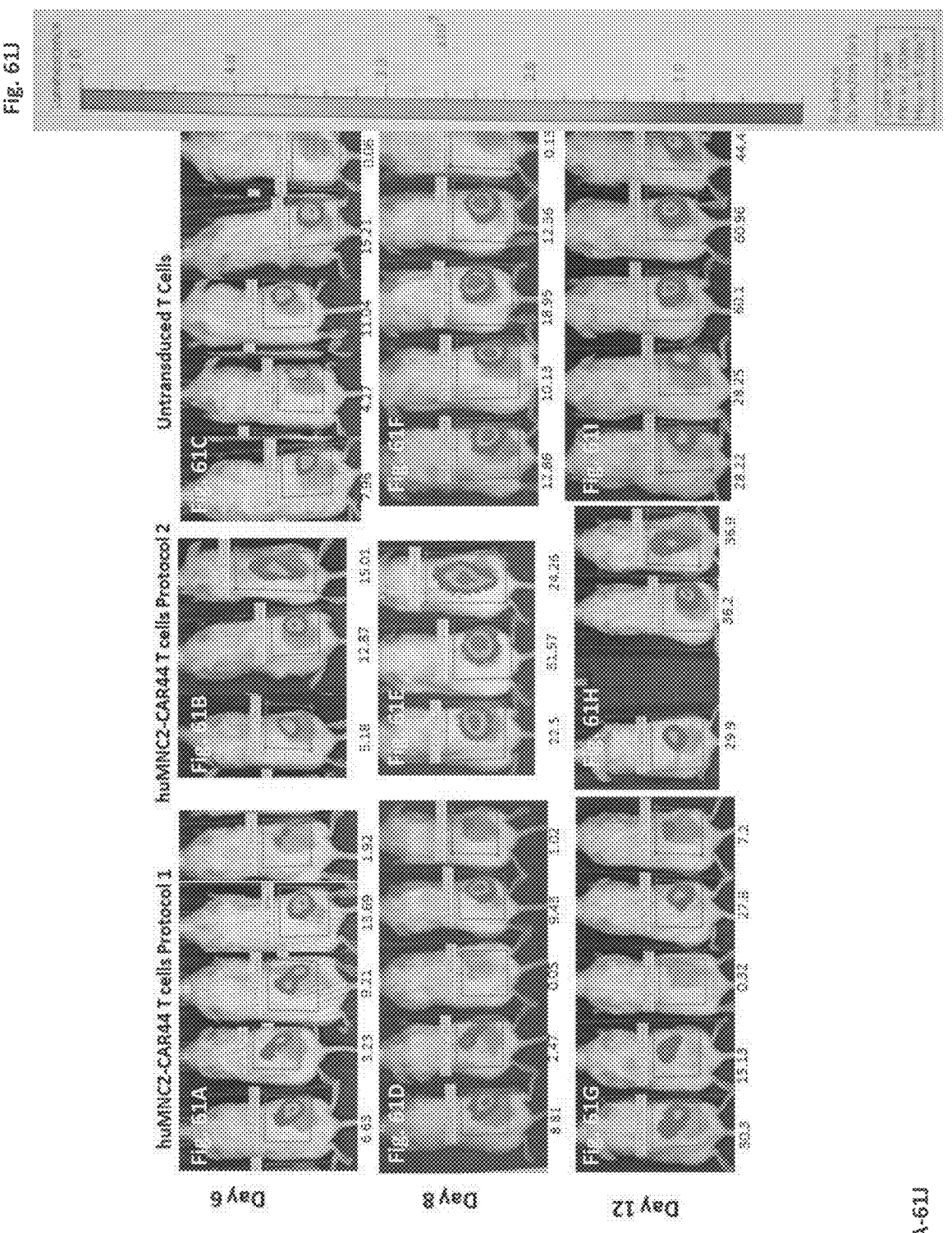

FIGS. 61A-61J show fluorescent photographs of mice taken on an IVIS instrument. NSG (NOD/SCID/GAMMA) immune compromised mice that on Day 0 were sub-cutaneously injected into the flank with 500K human BT-20 cells which are a MUC1* positive triple negative breast cancer cell line. The cancer cells had been stably transfected with Luciferase. Tumors were allowed to engraft. On Day 6 after IVIS measurement, animals were given a one-time injection of 10 million of either human T cells transduced with huMNC2-scFv-CAR44 or untransduced T cells. 5 million T cells were injected intra-tumor and 5 million were injected into the tail vein. 10 minutes prior to IVIS photographs, mice were IP injected with Luciferin, which fluoresces after cleavage by Luciferase, thus making tumor cells fluoresce. FIGS. 61A, 61D, 61G show photographs of mice that were treated with huMNC2-scFv-CAR44 T cells that had been pre-stimulated by co-culturing for 24 hours with 4 μm beads to which was attached a synthetic MUC1*, PSMGFR peptide 24 hours prior to administration: Protocol 1. FIGS. 61B, 61E, 61H show photographs of mice that were treated with huMNC2-scFv-CAR44 T cells that had been pre-stimulated by twice co-culturing for 24 hours with MUC1* positive cancer cells 24 hours prior to administration: Protocol 2. FIGS. 61C, 61F, 61I show photographs of mice that were treated with untransduced human T cells. FIG. 61J is a color scale relating fluorescence in photons/second to color.

Figures 62A, 62B, 62C, 62D, 62E, 62F, 62G, 62H, 62I, 62J, 62K, 62L, 62M:
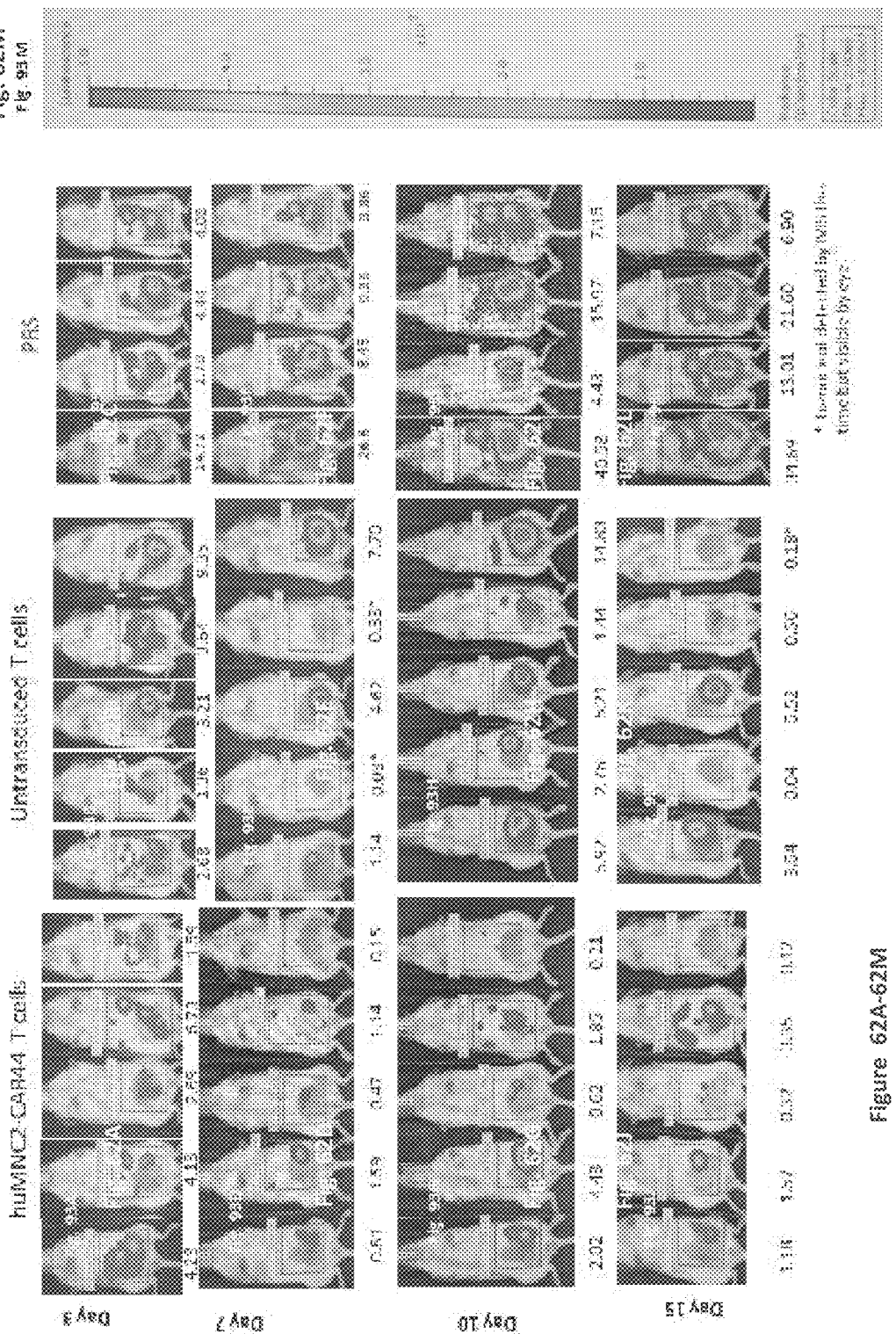

FIGS. 62A-62M show fluorescent photographs of mice taken on an IVIS instrument. NSG (NOD/SCID/GAMMA) immune compromised mice that on Day 0 were injected into the intraperitoneal cavity (IP) with 500K human SKOV-3 cells which are a MUC1* positive ovarian cancer cell line. The cancer cells had been stably transfected with Luciferase. Tumors were allowed to engraft. On Day 4, animals were injected into the intraperitoneal space with 10M either human T cells transduced with huMNC2-scFv-CAR44, untransduced T cells or PBS. On Day 11, animals were injected again except that half the cells were injected into the tail vein and the other half was IP injected. Animals were imaged by IVIS on Days 3, 7, 10 and 15. 10 minutes prior to IVIS photographs, mice were IP injected with Luciferin, which fluoresces after cleavage by Luciferase, thus making tumor cells fluoresce. FIGS. 62A, 62D, 62G, and 62J show photographs of mice that were treated with huMNC2-scFv- CAR44 T cells that had been pre-stimulated by co-culturing for 24 hours with lum beads to which was attached a synthetic MUC1*, PSMGFR peptide 24 hours prior to administration. FIGS. 62B, 62E, 62H, and 62K show photographs of mice that were treated with untransduced human T cells. FIGS. 62C, 62F, 62I, and 62L show photographs of mice that were treated with PBS. FIGS. 62A, 62B and 62C are IVIS images taken Day 3 prior to CAR T, T cell or PBS administration. FIGS. 62D, 62E and 62F show IVIS images of animals on Day 7, just four (4) days after treatment. FIGS. 62G, 62H, and 62I show IVIS images of animals on Day 10. FIGS. 62J, 62K, and 62L show IVIS images of animals on Day 15 FIG. 62M is the IVIS color scale relating fluorescence in photons/second to color.

FIG. 63 shows a graph of an ELISA binding assay in which various monoclonal antibodies are tested for their ability to bind to the PSMGFR peptide, the N-10, C-10, N+20/C-27, or the N+9/C-9 peptide, wherein the concentration of the antibody was at 10 ug/mL or 1 ug/mL. Note that anti-MUC1* monoclonal antibodies C2 and E6, which have been demonstrated to be cancer specific, bind to the PSMGFR peptide, still bind if the 10 N-terminal amino acids are missing, but do not bind if the 10 or 9 C-terminal amino acids are missing. Figure discloses SEQ ID NOS 823-824, 2-3, and 825, respectively, in order of appearance.

FIG. 64A-64B shows a graph of an ELISA binding assay. The antibodies being tested were derived from animals immunized with the PSMGFR peptide. The first selection criteria was to confirm that the antibodies bound to the immunizing PSMGFR peptide. FIG. 64A shows a graph of an ELISA of selected antibodies that were further tested to determine their ability to bind to the PSMGFR peptide, the N-10, the C-10, N+20/C-27, or N+9/C-9 peptide. All the antibodies except 18B4 were able to bind to the N-10 peptide. 18B4 recognized N+20/C-27 but not the N-10 peptide, implying that its cognate epitope lies within the GTINVHDVET sequence (SEQ ID NO: 1746). All except 20A10 and C2 showed some binding to the C-10 and N+9/C-9 peptide, showing that both 20A10 and C2 require the 10 membrane proximal amino acids for binding. C2, which requires the 10 membrane proximal amino acids for binding has been demonstrated to be cancer specific. FIG. 64B shows the sequences of the various peptides. The color of the bars for each antibody in the ELISA graph are color coded to match the deductive cognate sequence, or a portion thereof, of that antibody. Figure discloses SEQ ID NOS 823-824, 2-3, and 825, respectively, in order of appearance.

FIG. 65A-65B shows a graph of an ELISA binding assay in which various monoclonal antibodies are tested for their ability to bind to the PSMGFR peptide, the N-10, the C-10, N+20/C-27, or N+9/C-9 peptide. The antibodies being tested were derived from animals immunized with the N+20/C-27 peptide. The first selection criteria was to confirm that the antibodies bound to the immunizing N+20/C-27 peptide. FIG. 65A shows a graph of ELISA binding assay that tests the ability of each antibody to bind to various peptides. Although these antibodies were raised against the N+20/C-27 peptide, all but one, 45C11, still bind to the PSMGFR peptide. The binding of 45C11 is weak but deductive reasoning shows that the cognate epitope must lie within the SNIKFRPGSVV sequence (SEQ ID NO: 1744). 1E4 was able to bind to the N+20/C-27 peptide, the PSMGFR and the N-10 peptide, consistent with the idea that its epitope must lie within the QFNQYKTE sequence (SEQ ID NO: 1801). FIG. 65B shows the sequences of the various peptides. The color of the bars for each antibody in the ELISA graph are color coded to match the deductive cognate sequence, or a portion thereof, of that antibody. Figure discloses SEQ ID NOS 823-824, 2-3, and 825, respectively, in order of appearance.

Figures 66A, 66B:
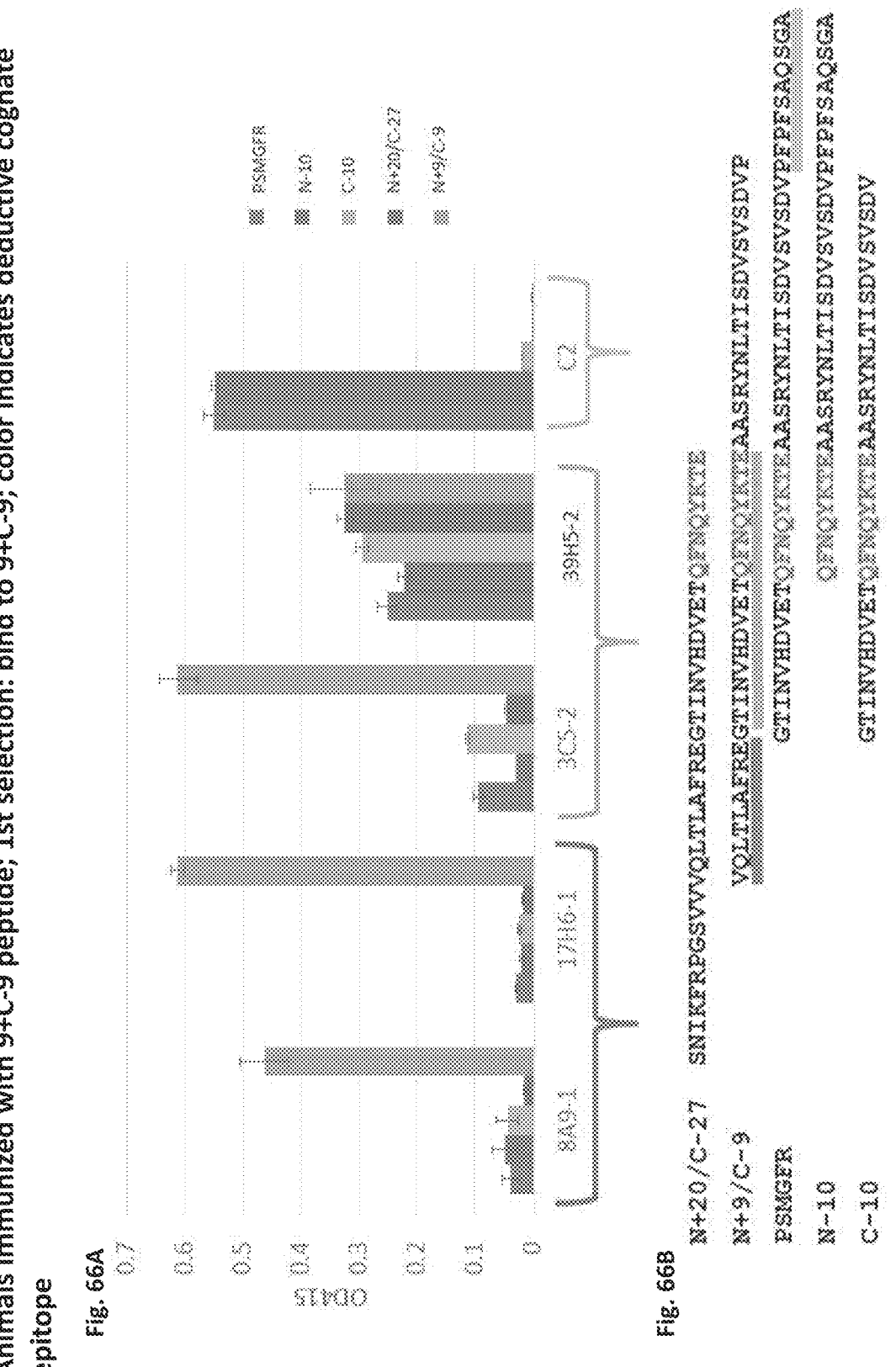

FIG. 66A-66B shows a graph of an ELISA binding assay in which various monoclonal antibodies are tested for their ability to bind to the PSMGFR peptide, the N-10, the C-10, N+20/C-27, or N+9/C-9 peptide. The antibodies being tested were derived from animals immunized with the N+9/C-9 peptide. The first selection criteria was to confirm that the antibodies bound to the immunizing N+9/C-9 peptide. FIG. 66A shows a graph of the ELISA assay. All but one, 39H5, were only able to bind to the immunizing peptide, N+9/C-9. 39H5 showed very weak binding to the PSMGFR and N-10 peptide, consistent with the idea that at least a portion of its cognate epitope must lie within the QFNQYKTE sequence (SEQ ID NO: 1801). FIG. 66B shows the sequences of the various peptides. The color of the bars for each antibody in the ELISA graph are color coded to match the deductive cognate sequence, or a portion thereof, of that antibody. Figure discloses SEQ ID NOS 823-824, 2-3, and 825, respectively, in order of appearance.

FIG. 67A-67D shows results of ELISA assays to further define antibody epitopes within the MUC1 or MUC1* extra cellular domain. The antibodies shown in this figure were all generated by immunizing animals with the PSMGFR peptide. Binding assays tested antibodies for their ability to bind to peptides N-19, N-26, N-30, N-10/C-5, N-19/C-5, PSMGFR, N-10 and C-10, which are all subsets of the PSMGFR peptide and numbering refers back to the PSMGFR peptide. FIG. 67A shows the binding of the various antibodies to the various peptides. FIG. 67B shows the sequence of the PSMGFR peptide that has been extended 20 amino acids at the N-terminus. Figure discloses SEQ ID NO: 822. FIG. 67C shows the sequences of the PSMGFR-derived subset peptides. Figure discloses SEQ ID NOS 4, 6-9, 2-3, and 825, respectively, in order of appearance. FIG. 67D shows the sequences that comprise all or part of the epitope that is essential for antibody recognition. Figure discloses SEQ ID NOS 1745, 1745-1746, 1745, 1747, 1745, 1747, and 1747, respectively, in order of appearance.

FIG. 68A-68D shows results of ELISA assays to further define antibody epitopes within the MUC1 or MUC1* extra cellular domain. The antibodies shown in this figure were all generated by immunizing animals with the N+20/C-27 peptide. Binding assays tested antibodies for their ability to bind to peptides N-19, N-26, N-30, N-10/C-5, N-19/C-5, PSMGFR, N-10 and C-10, which are all subsets of the PSMGFR peptide and numbering refers back to the PSMGFR peptide. FIG. 68A shows the binding of the various antibodies to the various peptides. FIG. 68B shows the sequence of the PSMGFR peptide that has been extended 20 amino acids at the N-terminus. Figure discloses SEQ ID NO: 822. FIG. 68C shows the sequences of the PSMGFR-derived subset peptides. Figure discloses SEQ ID NOS 4, 6-9, 2-3, and 825, respectively, in order of appearance. FIG. 68D shows the sequences that comprise all or part of the epitope that is essential for antibody recognition. Figure discloses SEQ ID NOS 1746, 1746, 1746, 1744, and 1749, respectively, in order of appearance.

FIGS. 69A-69D show results of ELISA assays to further define antibody epitopes within the MUC1 or MUC1* extra cellular domain. The antibodies shown in this figure were all generated by immunizing animals with the N+9/C-9 peptide. Binding assays tested antibodies for their ability to bind to peptides N-19, N-26, N-30, N-10/C-5, N-19/C-5, PSMGFR, N-10 and C-10, which are all subsets of the PSMGFR peptide and numbering refers back to the PSMGFR peptide.

FIG. 69A shows the binding of the various antibodies to the various peptides. FIG. 69B shows the sequence of the PSMGFR peptide that has been extended 20 amino acids at the N-terminus. Figure discloses SEQ ID NO: 822. FIG. 69C shows the sequences of the PSMGFR-derived subset peptides. Figure discloses SEQ ID NOS 4, 6-9, 2-3, and 825, respectively, in order of appearance. FIG. 69D shows the sequences that comprise all or part of the epitope that is essential for antibody recognition. Figure discloses SEQ ID NOS 1746, 1746, 1750, and 1750, respectively, in order of appearance.

Figures 70A, 70B:
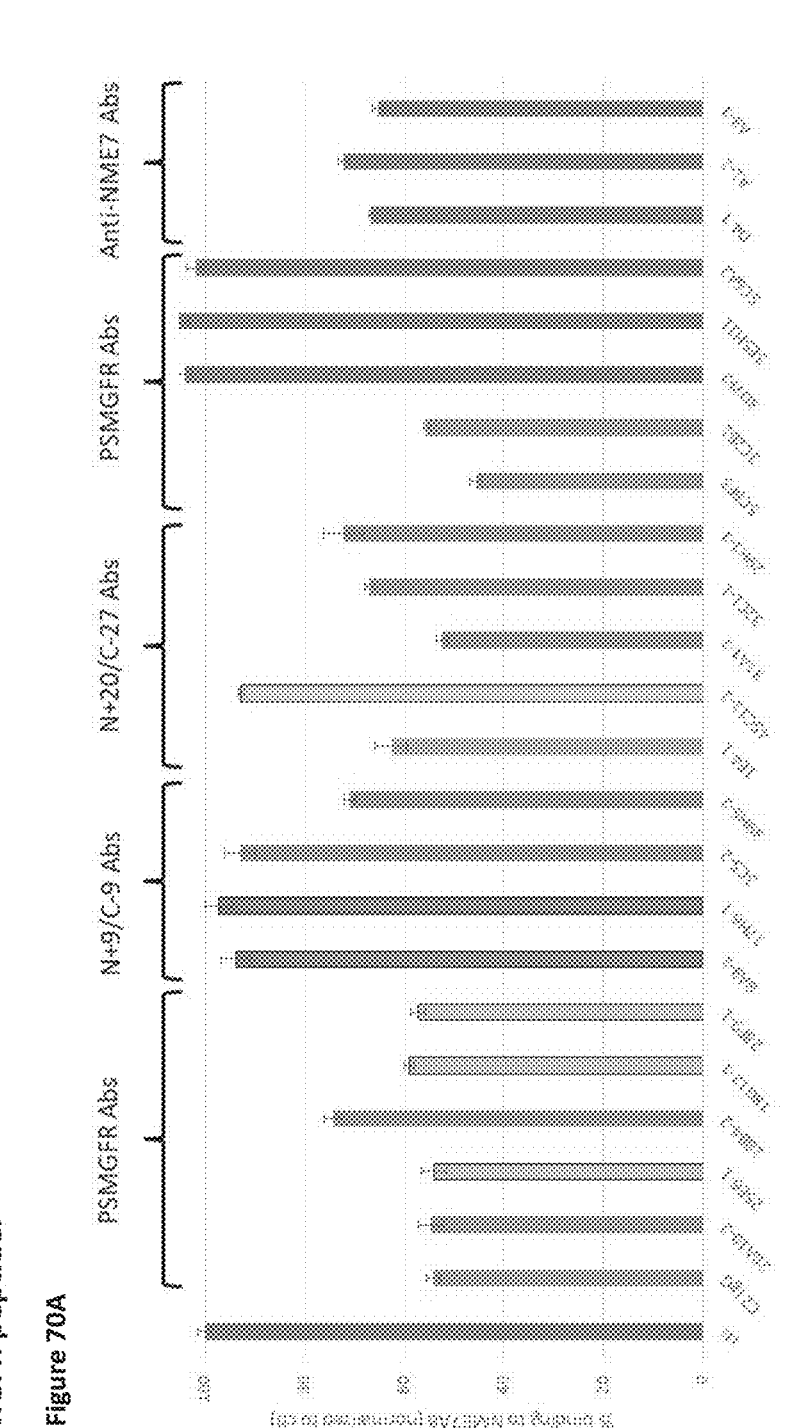

FIG. 70 shows a graph of an ELISA displacement assay. In this experiment, a multi-well plate was coated with the PSMGFR peptide. Recombinant $NME7_{AB}$ was allowed to bind to the surface-immobilized PSMGFR peptide. Various antibodies were added, followed by a wash step. The amount of $NME7_{AB}$ that remained attached to the PSMGFR coated plate, after antibody competition, was measured by detecting a tag on the $NME7_{AB}$. As a control, anti-$NME7_{AB}$ antibodies were also tested for their ability to displace $NME7_{AB}$ from the PSMGFR. Figure discloses SEQ ID NO: 822.

Figures 71A, 71B, 71C, 71D:
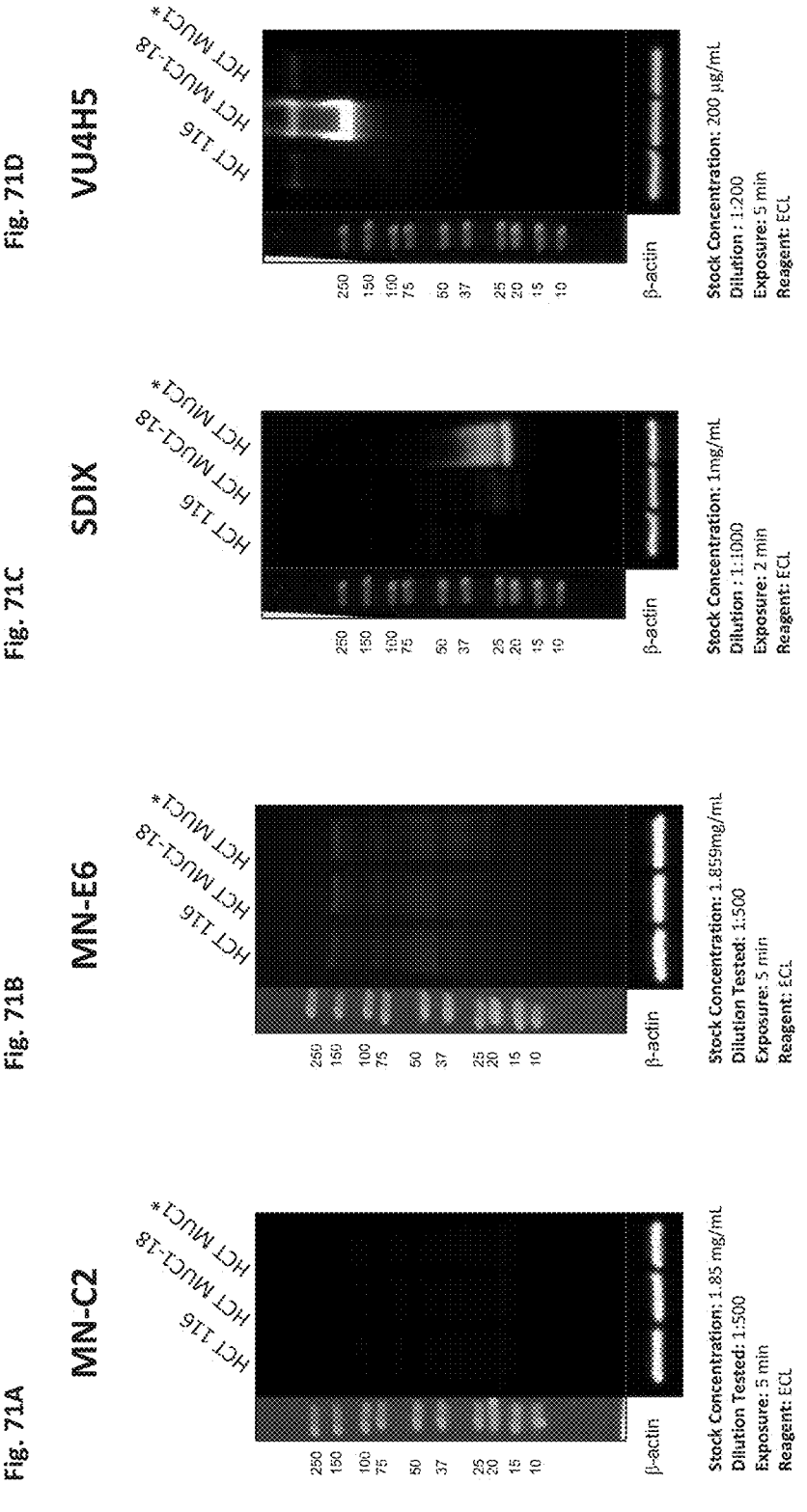
Figures 71E, 71F, 71G, 71H:
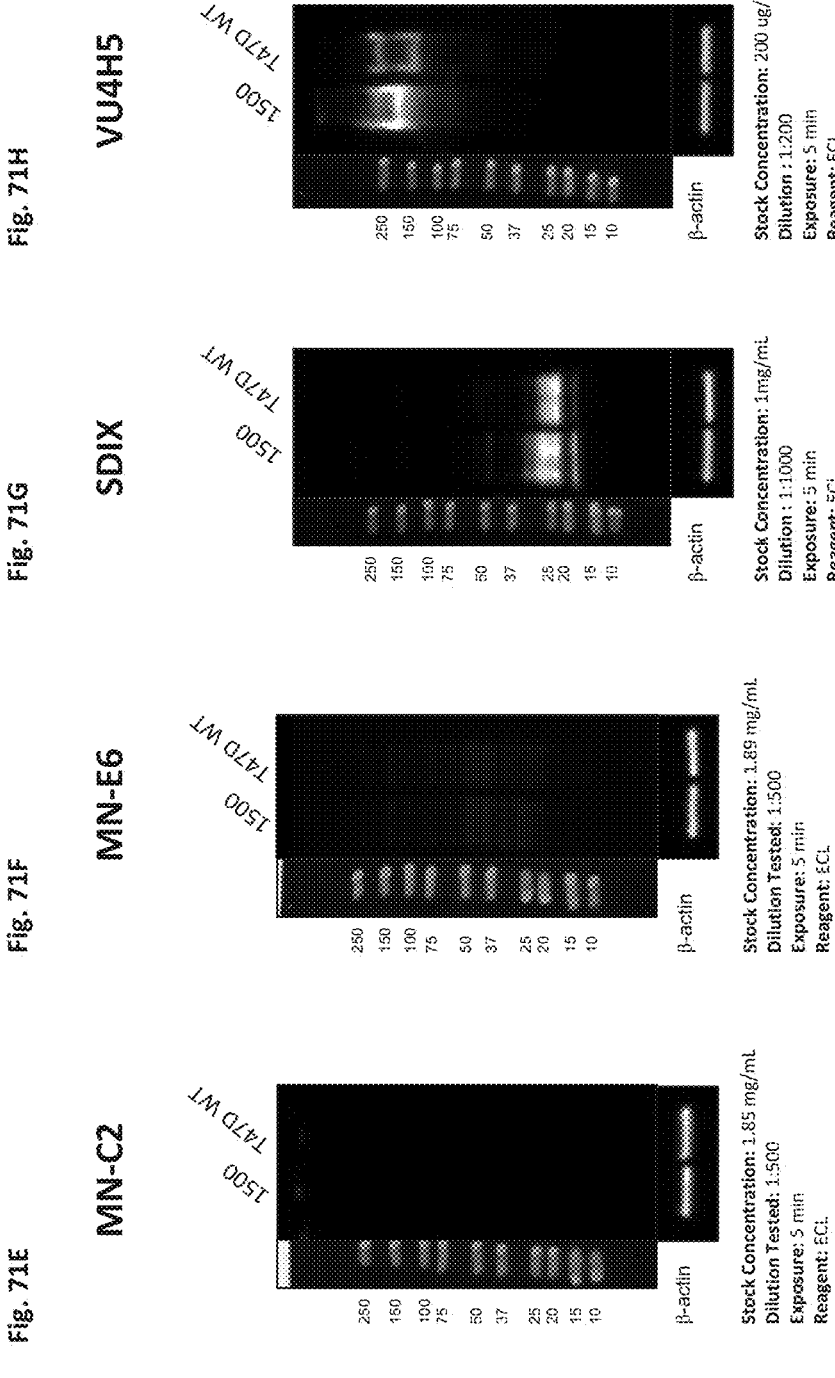

FIG. 71A-71H shows photographs of Western blots in which antibodies are tested for their ability to bind to a linear epitope in full-length MUC1 or MUC1*. FIG. 71A-71D shows testing of antibodies for ability to bind to a MUC1 negative cell line, HCT-116, or engineered cell lines HCT-MUC1-18, which is a cleavage resistant clone that expresses full-length MUC1, or HCT-MUC1*, which is engineered to express only the PSMGFR sequence in its extra cellular domain. FIG. 71E-71H shows testing of antibodies for ability to bind to breast cancer cell lines T47D or 1500 aka ZR-75-1. FIG. 71A and FIG. 71E show MNC2, a monoclonal antibody raised against PSMGFR peptide that binds to N-10 but not C-10 variants of the PSMGFR peptide. FIG. 71B and FIG. 71F show MNE6, a monoclonal antibody raised against PSMGFR peptide that binds to N-10 but not C-10 variants of the PSMGFR peptide. FIG. 71C and FIG. 71G show SDIX, a polyclonal antibody raised against PSMGFR peptide and which binds to the PSMGFR peptide. FIG. 71D and FIG. 71H show VU4H5, a commercially available monoclonal antibody that binds to the tandem repeats of full-length MUC1. As can be seen, neither MNC2 nor MNE6 bind linear epitopes of MUC1 species.

Figures 72A, 72B, 72C, 72D, 72E, 72F, 72G, 72H:
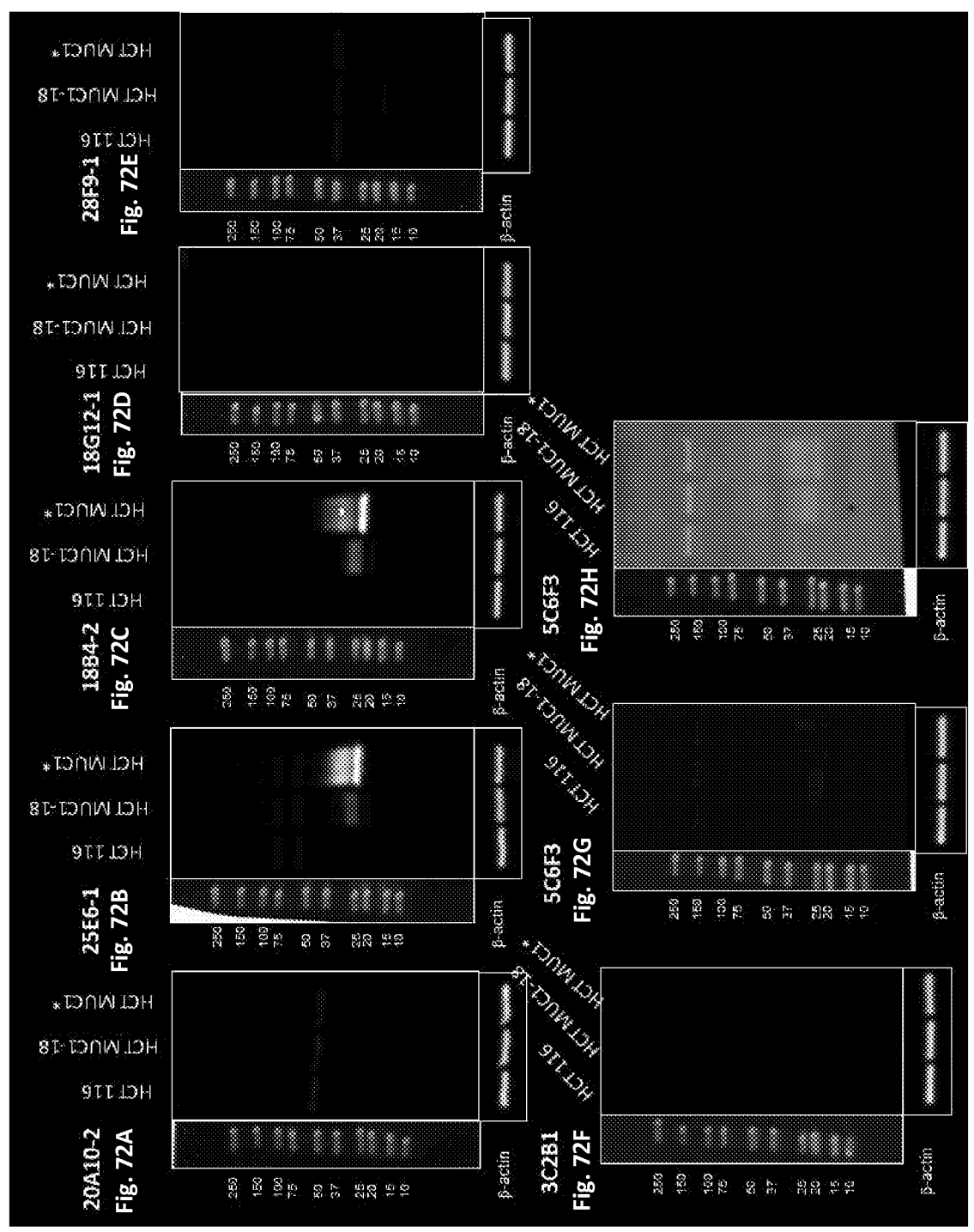
Figures 72I, 72J, 72K, 72L, 72M, 72N, 72O, 72P:
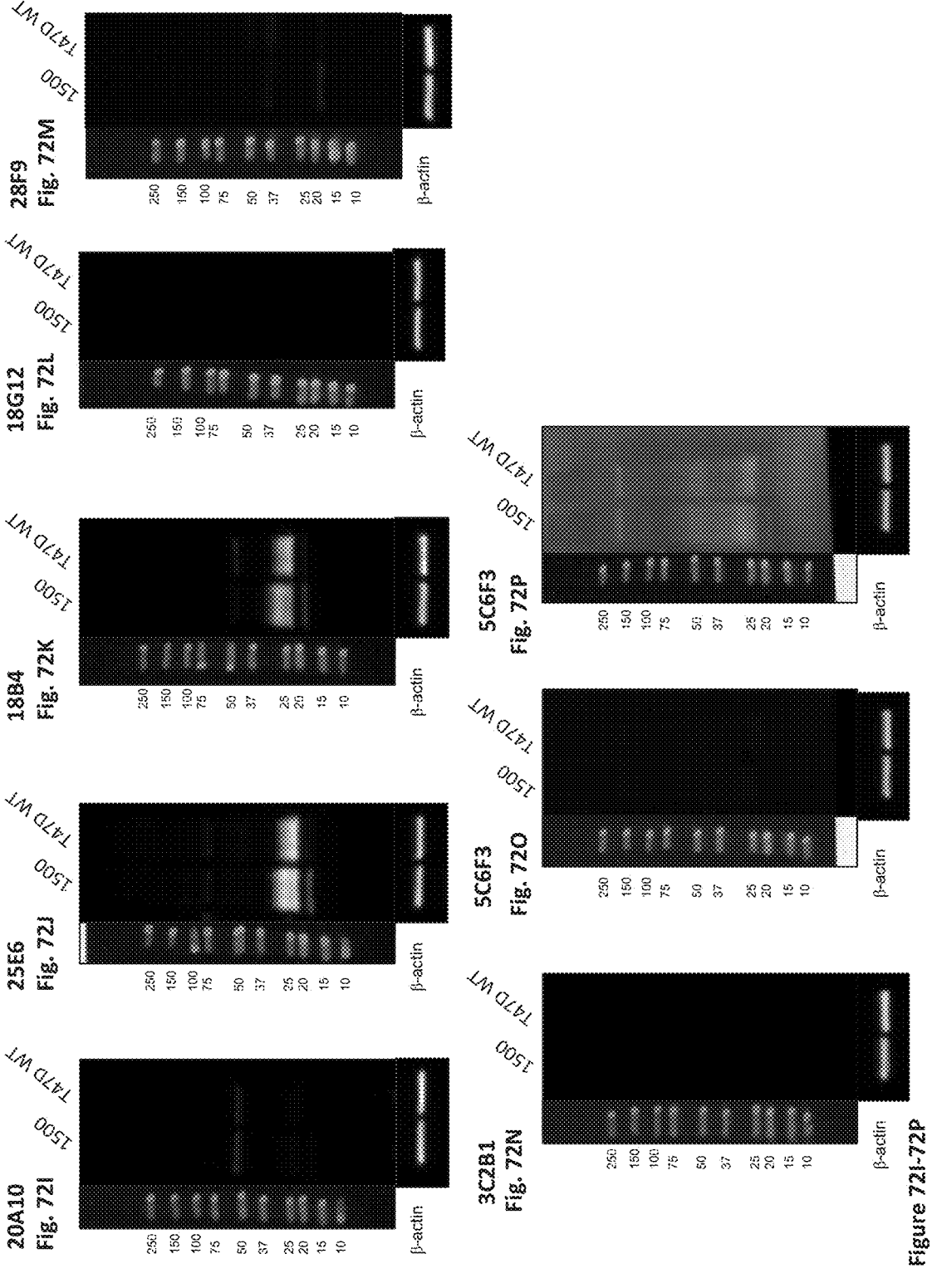

FIG. 72A-72P shows photographs of Western blots in which antibodies are tested for their ability to bind to a linear epitope in full-length MUC1 or MUC1*. All these antibodies were raised against the PSMGFR peptide and bind to the PSMGFR peptide. FIG. 72A-72H shows testing of antibodies for ability to bind to a MUC1 negative cell line, HCT-116, or engineered cell lines HCT-MUC1-18, which is a cleavage resistant clone that expresses full-length MUC1, or HCT-MUC1*, which is engineered to express only the PSMGFR sequence in its extra cellular domain. FIG. 72I-72P shows testing of antibodies for ability to bind to breast cancer cell lines T47D or 1500 aka ZR-75-1. FIG. 72A and FIG. 72I show 20A10. FIG. 72B and FIG. 72J show 25E6. FIG. 72C and FIG. 72K show 18B4. FIG. 72D and FIG. 72L show 18G12. FIG. 72E and FIG. 72M show 28F9. FIG. 72F and FIG. 72N show 3C2B1. FIG. 72G and FIG. 72O show 5C6F3. FIG. 72H and FIG. 72P show 5C6F3 wherein the blot has been exposed for a longer time period to render more visible the MUC1* specific bands. As can be seen, antibodies 25E6, 18B4 and to a degree 5C6F3 recognize linear epitopes but 20A10, 3C2B1, 18G12 and 28F9 do not.

Figures 73A, 73B, 73C, 73D, 73E:
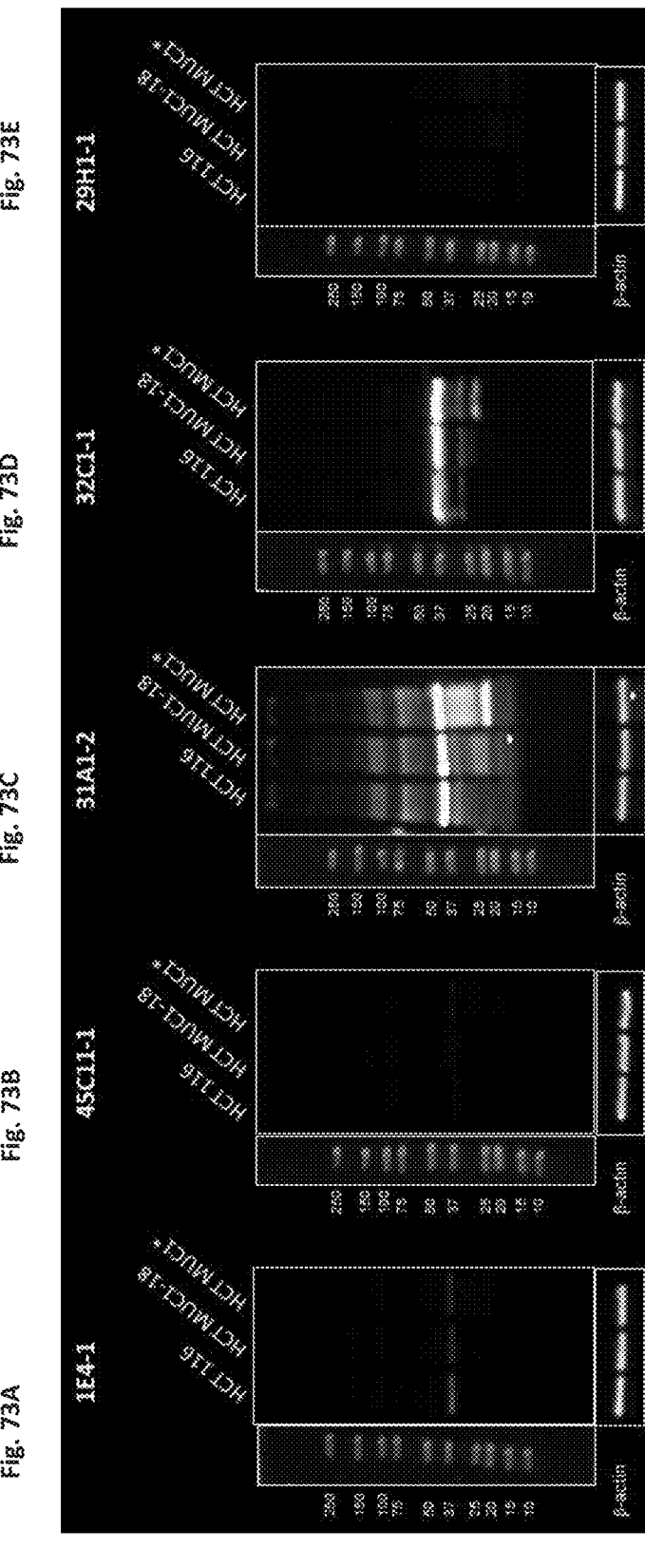

FIG. 73A-73J shows photographs of Western blots in which antibodies are tested for their ability to bind to a linear epitope in full-length MUC1 or MUC1*. All these antibodies were raised against the N+20/C-27 variant of the PSMGFR peptide and bind to the N+20/C-27 peptide. FIG. 73A-73E shows testing of antibodies for ability to bind to a MUC1 negative cell line, HCT-116, or engineered cell lines HCT-MUC1-18, which is a cleavage resistant clone that expresses full-length MUC1, or HCT-MUC1*, which is engineered to express only the PSMGFR sequence in its extra cellular domain. FIG. 73F-73J shows testing of antibodies for ability to bind to breast cancer cell lines T47D or 1500 aka ZR-75-1. FIG. 73A and FIG. 73F show 1E4. FIG. 73B and FIG. 73G show 45C11. FIG. 73C and FIG. 73H show 31A1. FIG. 73D and FIG. 73I show 32C1. FIG. 73E and FIG. 73J show 29H1. As can be seen, antibodies 31A1 and 32C1 recognize linear epitopes.

Figures 74A, 74B, 74C, 74D:
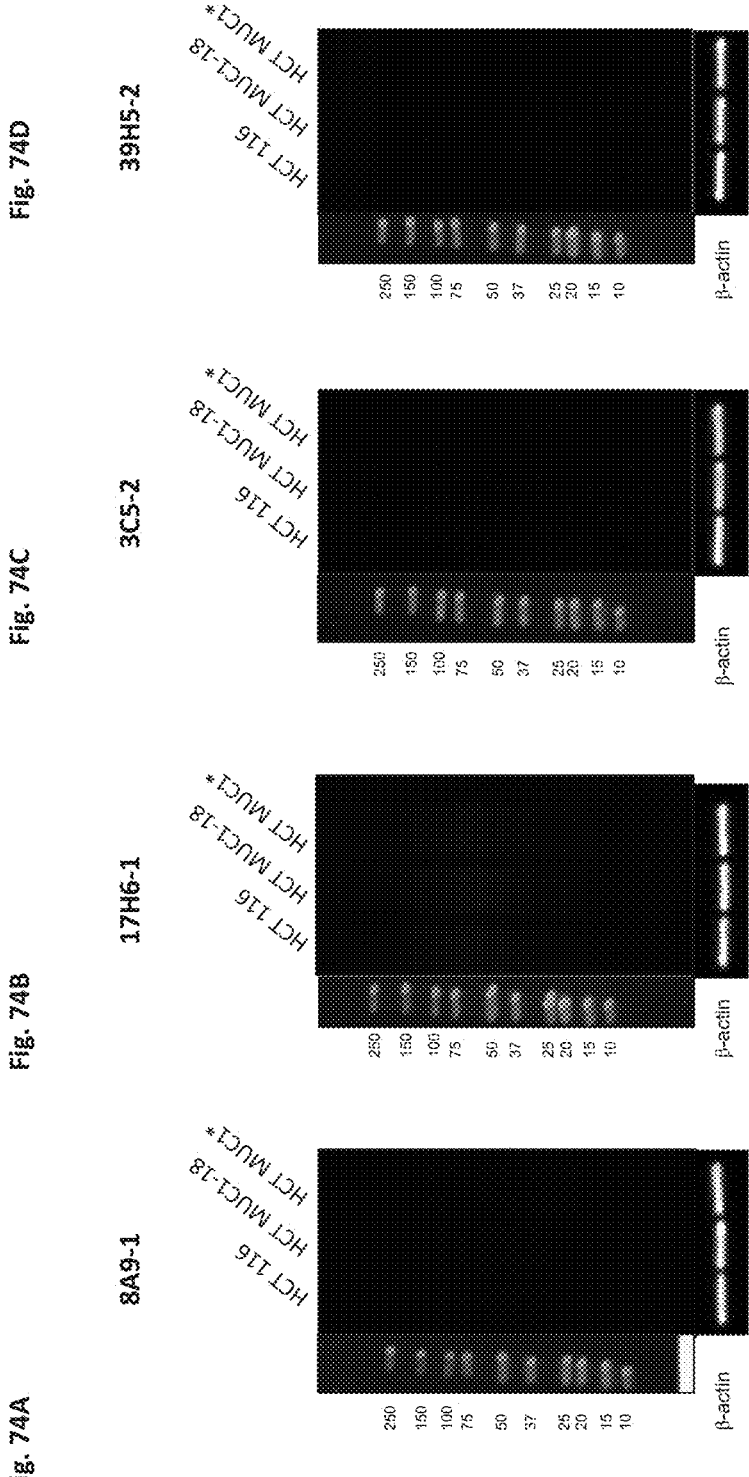
Figures 74E, 74F, 74G, 74H:
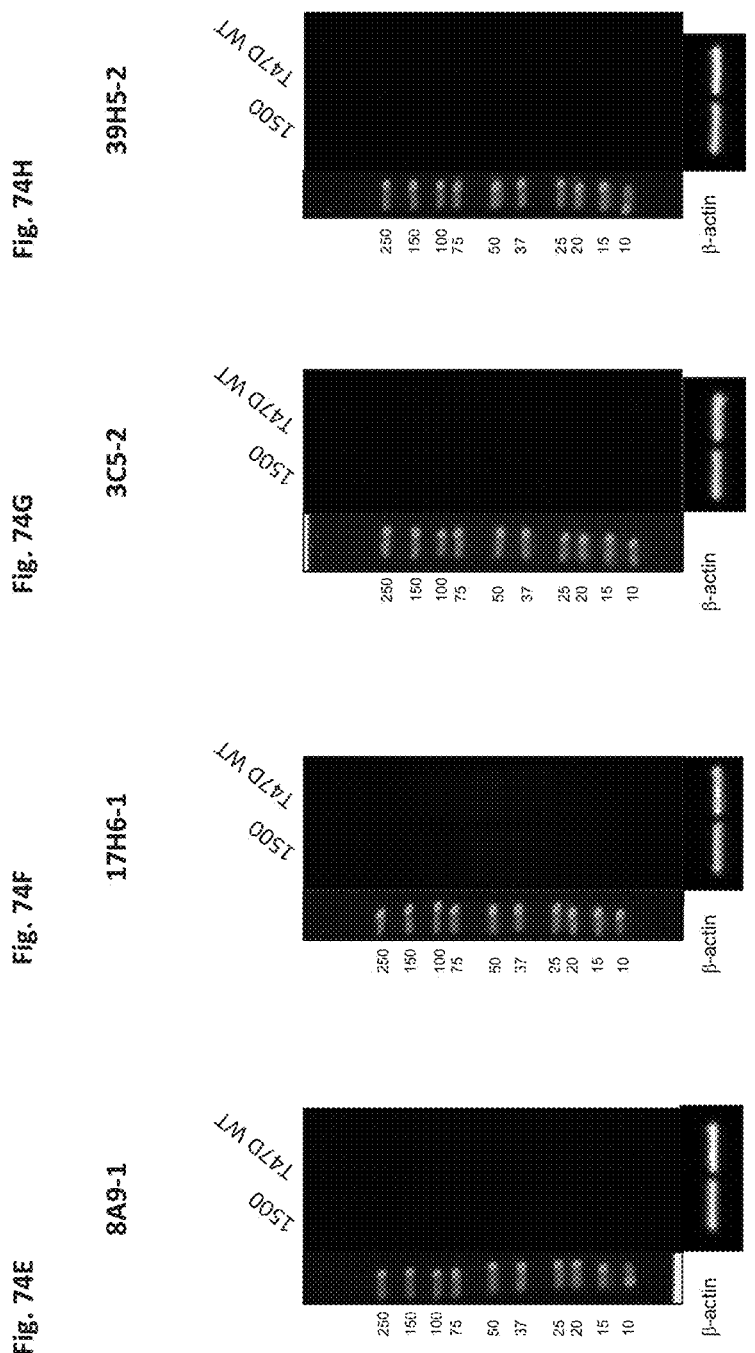

FIG. 74A-74H shows photographs of Western blots in which antibodies are tested for their ability to bind to a linear epitope in full-length MUC1 or MUC1*. All these antibodies were raised against the N+9/C-9 variant of the PSMGFR peptide and bind to the N+9/C-9 peptide. FIG. 74A-74D shows testing of antibodies for ability to bind to a MUC1 negative cell line, HCT-116, or engineered cell lines HCT-MUC1-18, which is a cleavage resistant clone that expresses full-length MUC1, or HCT-MUC1*, which is engineered to express only the PSMGFR sequence in its extra cellular domain. FIG. 74E-74H shows testing of antibodies for ability to bind to breast cancer cell lines T47D or 1500 aka ZR-75-1. FIG. 74A and FIG. 74E show 8A9. FIG. 74B and FIG. 74F show 17H6. FIG. 74C and FIG. 74G show 3C5. FIG. 74D and FIG. 74H show 39H5.

Figures 75O, 75P:
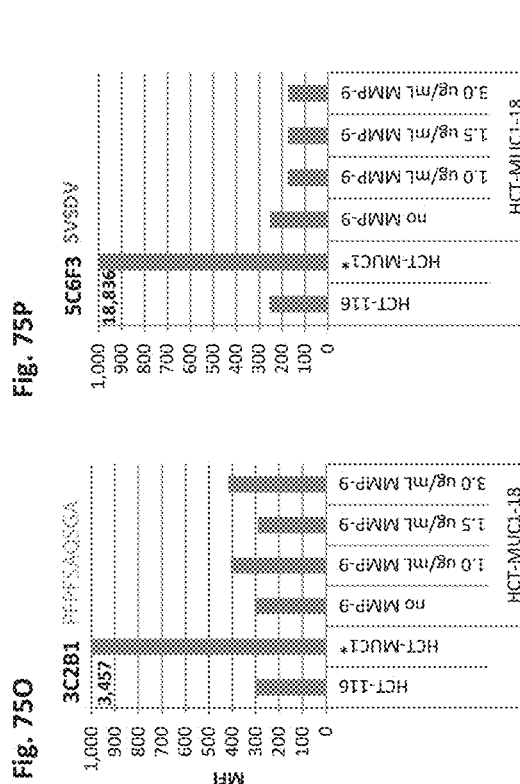

FIG. 75A-75P show graphs of FACS analysis. HCT-MUC1-18 cells, which express full-length MUC1, were incubated with a catalytically active MMP9 or MMP2 for 24 hours, incubated with an antibody of the invention and then analyzed by FACS to see if the antibody bound to the MMP9 or the MMP2 cleaved form of MUC1. Note that the first bar of each graph shows that none of the antibodies binds to full-length MUC1 in the absence of cleavage. Each bar graph is labeled with both the name of the antibody used in that assay and its cognate epitope. The order of the graphs from right to left corresponds to the distance the from the cell surface of the antibody's cognate epitope. FIG. 75A shows antibody 1E4. FIG. 75B shows antibody 28F9. FIG. 75C shows antibody 18G12. FIG. 75D shows antibody 25E6. FIG. 75E shows antibody 20A10. FIG. 75F shows antibody 3C5. FIG. 75G shows antibody 29H1. FIG. 75H shows antibody 32C1. FIG. 75I shows antibody 31A1. FIG. 75J shows antibody 18B4. FIG. 75K shows antibody 45C11. FIG. 75L shows antibody 8A9. FIG. 75M shows antibody 17H6. FIG. 75N shows antibody 39H5. FIG. 75O shows antibody 3C2B1. FIG. 75P shows antibody 5C6F3. Figure discloses SEQ ID NOS 822, 1749, 1745, 1745, 1745, 1743, 1746, 1746, 1746, 1746, 1746, 1744, 1750, 1750, 1746, 822, 1743, and 1751, respectively, in order of appearance.

FIG. 76A-76J show graphs of FACS analyses of reference antibodies MNC2, "C2", and VU4H5 binding to either the MUC1-negative cell line HCT-116, HCTs transfected with MUC1*, "HCT-MUC1*", a cleavage resistant single cell clone of HCTs transfected with MUC1 full-length, "HCT-MUC1-18", and MNC2 binding to breast cancer cells line T47D or breast cancer cell line 1500 also known as ZR-75-1. MNC2 binds to an ectopic binding site on the extra cellular domain of MUC1*, within the membrane proximal portion of the PSMGFR sequence. The MNC2 binding site is only available after cleavage and release of the bulk of the extra cellular domain comprising the tandem repeat domain. VU4H5 binds to hundreds of repeating epitopes in the tandem repeat domain. FIG. 76A-76E show percent binding and FIG. 76F-76J show Mean Fluorescent Intensity or MFI.

FIG. 77A-77N show graphs of FACS analyses of reference antibody MNC2, "C2", binding to a panel of cancer cell lines that are MUC1* positive, with the exception of MDA-MB-231, which expresses MUC1 and MUC1* at a level that is so low that it is often used as a negative control. MNC2 binds to an ectopic binding site on the extra cellular domain of MUC1*, within the membrane proximal portion of the PSMGFR sequence. The MNC2 binding site is only available after cleavage and release of the bulk of the extra cellular domain comprising the tandem repeat domain. FIG. 77A-77G show percent binding and FIG. 77H-77N show Mean Fluorescent Intensity or MFI. FIGS. 77A and 77H show the antibodies binding to lung cancer cell line NCI-H292. FIGS. 77B and 77I show the antibodies binding to lung cancer cell line NCI-H1975. FIGS. 77C and 77J show the antibodies binding to ovarian cancer cell line SKOV-3. FIGS. 77D and 77K show the antibodies binding to pancreatic cancer cell line HPAF-II. FIGS. 77E and 77L show the antibodies binding to pancreatic cancer cell line Capan-1. FIGS. 77F and 77M show the antibodies binding to prostate cancer cell line DU145. FIGS. 77G and 77N show the antibodies binding to breast cancer cell line MDA-MB-231, which is nearly MUC1 and MUC1* negative.

Figures 78A, 78B, 78C:
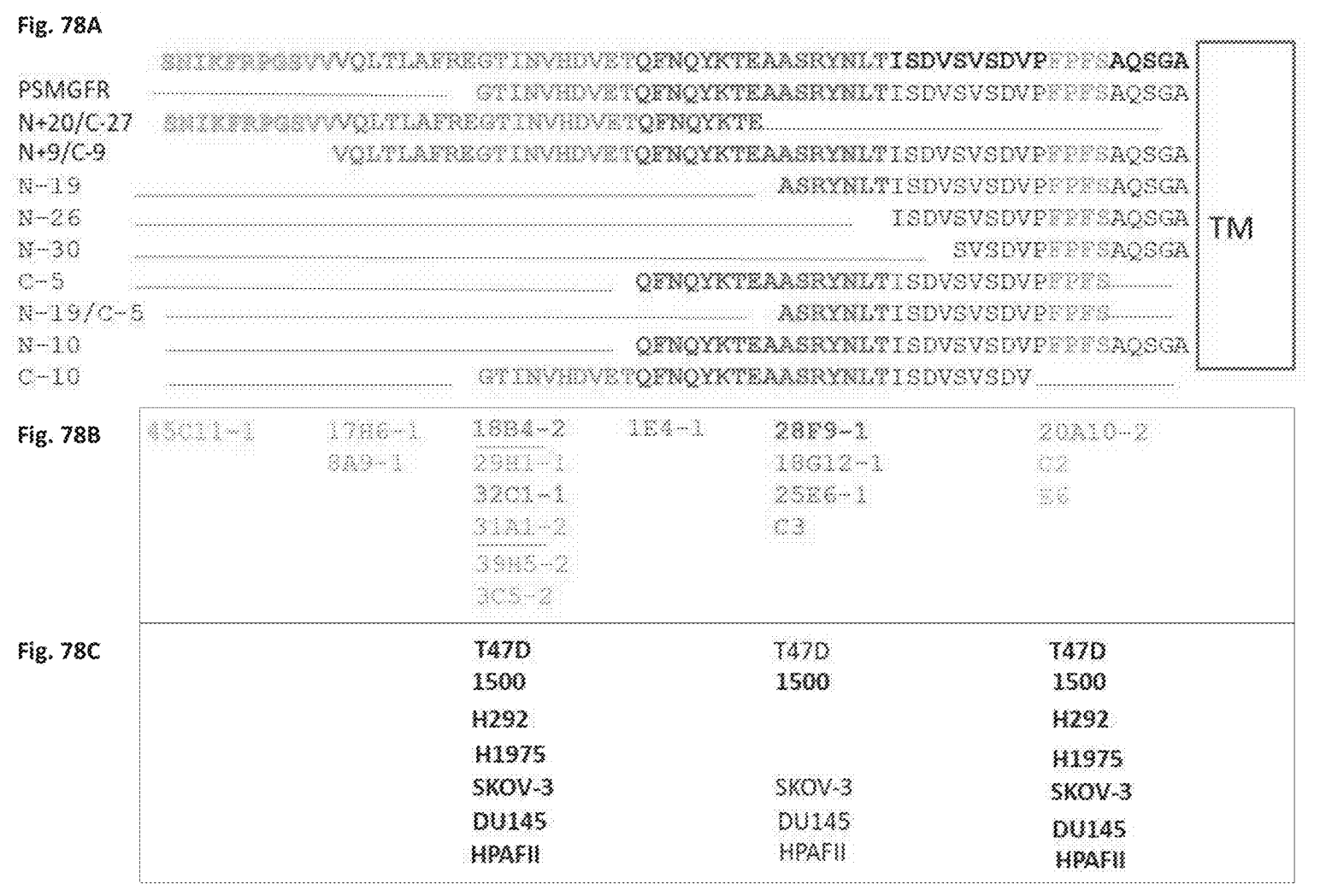

FIG. 78A-78C shows a color coded schematic of the basic PSMGFR sequence that has been extended or deleted at both the N- and C-termini. Antibodies of the invention were tested against this subset of peptides to further refine the epitopes to which each antibody binds or the critical amino acids within the epitope to which each antibody binds. FIG. 78A is an aligned schematic of the various subsets of peptides. Figure discloses SEQ ID NOS 822, 2, 823, 1792, 4, 6-9, 3, and 825, respectively, in order of appearance. FIG. 78B lists the antibodies that bind to each of the color coded sequences. FIG. 78C lists the cancer cell lines that each antibody recognizes.

FIG. 79A-79I shows color coded graphs that resulted from FACS analyses of each antibody binding to T47D breast cancer cells and their respective cognate sequences within the N-terminally extended PSMGFR sequence. FIG. 79A-79D are FACS graphs showing the percent cells that were recognized by each antibody. FIG. 79E-79H are FACS graphs showing the Mean Fluorescence Intensity, MFI, of each antibody. FIG. 79A and FIG. 79E show the FACS graph of antibodies that were generated by immunizing with the PSMGFR peptide. FIG. 79B and FIG. 79F show the FACS graph of antibodies that were generated by immunizing with the N+20/C-27 peptide. FIG. 79C and FIG. 79G show the FACS graph of antibodies that were generated by immunizing with the N+9/C-9 peptide. FIG. 79D and FIG. 79H also show the FACS graph of antibodies that were generated by immunizing with the PSMGFR peptide. FIG. 79I shows the PSMGFR sequence that is extended at the N-terminus by 20 amino acids. Figure discloses SEQ ID NO: 822.

FIG. 80A-80I shows color coded graphs that resulted from FACS analyses of each antibody binding to 1500, also known as ZR-75-1, breast cancer cells and their respective cognate sequences within the N-terminally extended PSMGFR sequence. FIG. 80A-80C are FACS graphs showing the percent cells that were recognized by each antibody. FIG. 80D-80F are FACS graphs showing the Mean Fluorescence Intensity, MFI, of each antibody. FIG. 80A, FIG. 80E, FIG. 80D and FIG. 80H show the FACS graph of antibodies that were generated by immunizing with the PSMGFR peptide. FIG. 80B and FIG. 80F show the FACS graph of antibodies that were generated by immunizing with the N+20/C-27 peptide. FIG. 80C and FIG. 80G show the FACS graph of antibodies that were generated by immunizing with the N+9/C-9 peptide. FIG. 80I shows the PSMGFR sequence that is extended at the N-terminus by 20 amino acids. Figure discloses SEQ ID NO: 822.

FIG. 81A-81G shows color coded graphs that resulted from FACS analyses of each antibody binding to NCI-H292 lung cancer cells and their respective cognate sequences within the N-terminally extended PSMGFR sequence. FIG. 81A-81C are FACS graphs showing the percent cells that were recognized by each antibody. FIG. 81D-81F are FACS graphs showing the Mean Fluorescence Intensity, MFI, of each antibody. FIG. 81A and FIG. 81D show the FACS graph of antibodies that were generated by immunizing with the PSMGFR peptide. FIG. 81B and FIG. 81E show the FACS graph of antibodies that were generated by immunizing with the N+20/C-27 peptide. FIG. 81C and FIG. 81F show the FACS graph of antibodies that were generated by immunizing with the N+9/C-9 peptide. FIG. 81G shows the PSMGFR sequence that is extended at the N-terminus by 20 amino acids. Figure discloses SEQ ID NO: 822.

Figures 82A, 82B, 82C, 82D, 82E, 82F, 82G:
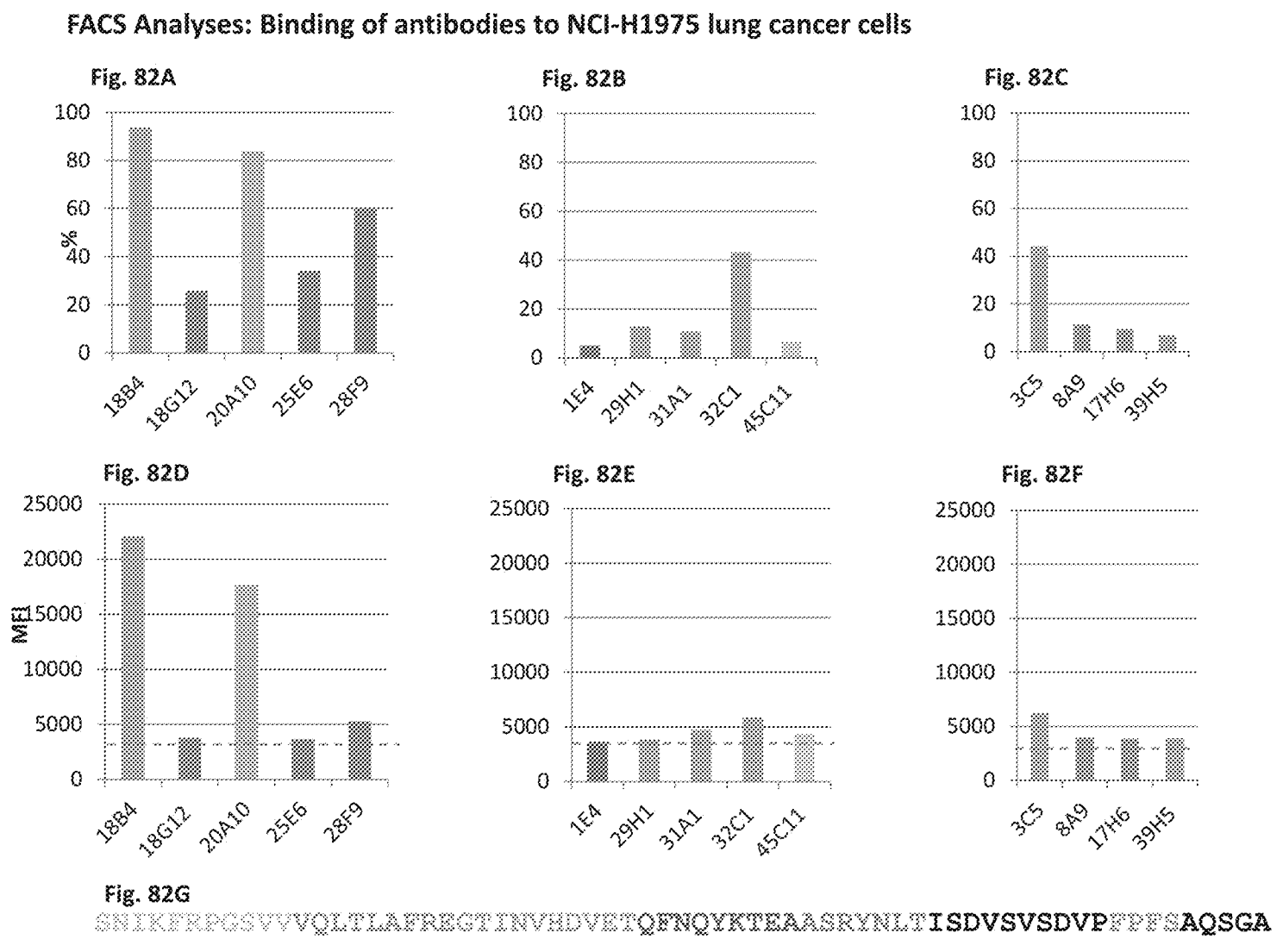

FIG. 82A-82G shows color coded graphs that resulted from FACS analyses of each antibody binding to NCI-H1975 lung cancer cells and their respective cognate sequences within the N-terminally extended PSMGFR sequence. FIG. 82A-82C are FACS graphs showing the percent cells that were recognized by each antibody. FIG. 82D-82F are FACS graphs showing the Mean Fluorescence Intensity, MFI, of each antibody. FIG. 82A and FIG. 82D show the FACS graph of antibodies that were generated by immunizing with the PSMGFR peptide. FIG. 82B and FIG. 82E show the FACS graph of antibodies that were generated by immunizing with the N+20/C-27 peptide. FIG. 82C and FIG. 82F show the FACS graph of antibodies that were generated by immunizing with the N+9/C-9 peptide. FIG. 82G shows the PSMGFR sequence that is extended at the N-terminus by 20 amino acids. Figure discloses SEQ ID NO: 822.

FIG. 83A-83G shows color coded graphs that resulted from FACS analyses of each antibody binding to SKOV-3 ovarian cancer cells and their respective cognate sequences within the N-terminally extended PSMGFR sequence. FIG. 83A-83C are FACS graphs showing the percent cells that were recognized by each antibody. FIG. 83D-83F are FACS graphs showing the Mean Fluorescence Intensity, MFI, of each antibody. FIG. 83A and FIG. 83D show the FACS graph of antibodies that were generated by immunizing with the PSMGFR peptide. FIG. 83B and FIG. 83E show the FACS graph of antibodies that were generated by immunizing with the N+20/C-27 peptide. FIG. 83C and FIG. 83F show the FACS graph of antibodies that were generated by immunizing with the N+9/C-9 peptide. FIG. 83G shows the PSMGFR sequence that is extended at the N-terminus by 20 amino acids. Figure discloses SEQ ID NO: 822.

Figures 84A, 84B, 84C, 84D, 84E, 84F, 84G, 84H, 84I:
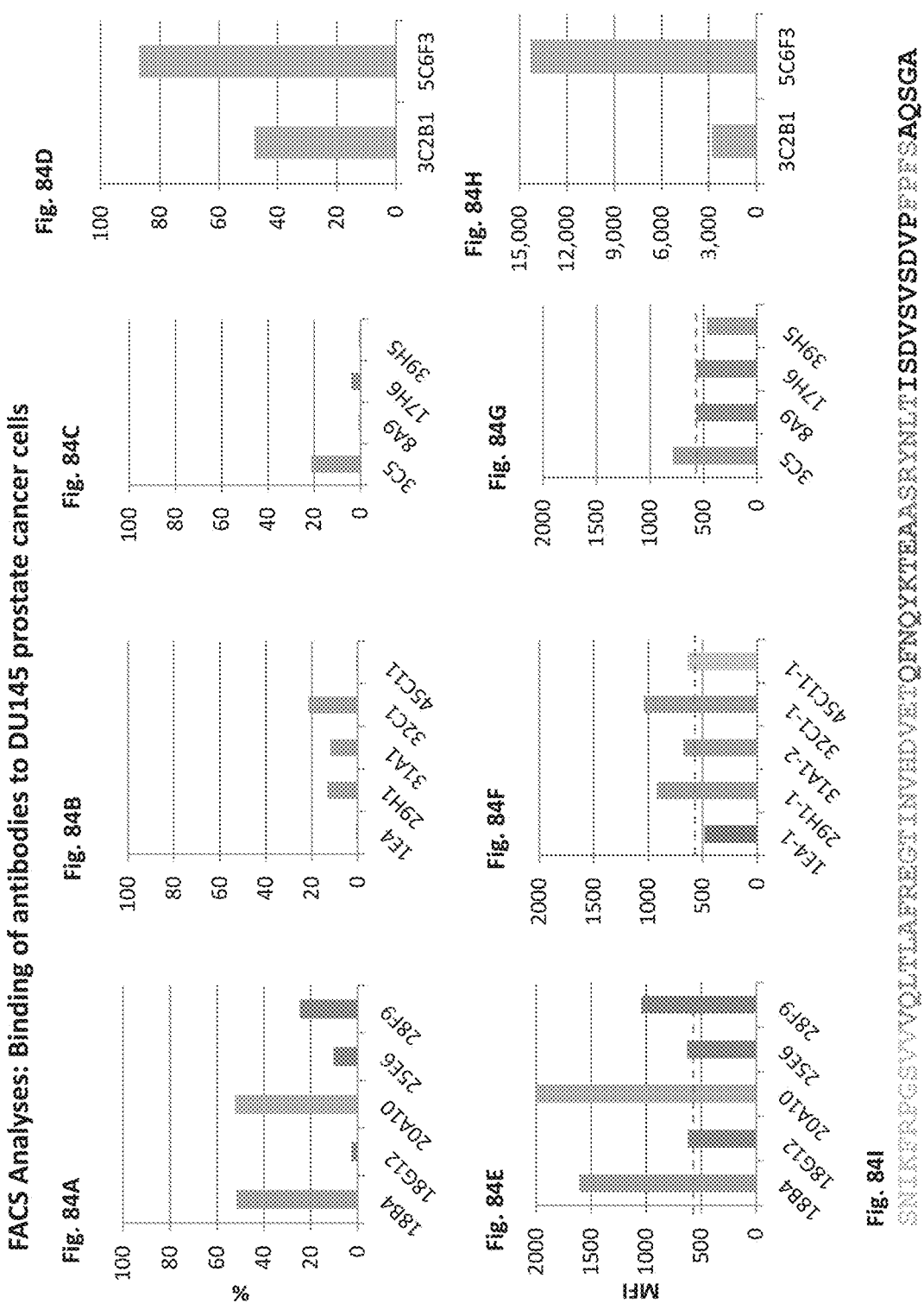

FIG. 84A-84G shows color coded graphs that resulted from FACS analyses of each antibody binding to DU145 prostate cancer cells and their respective cognate sequences within the N-terminally extended PSMGFR sequence. FIG. 84A-84C are FACS graphs showing the percent cells that were recognized by each antibody. FIG. 84D-84F are FACS graphs showing the Mean Fluorescence Intensity, MFI, of each antibody. FIG. 84A and FIG. 84D show the FACS graph of antibodies that were generated by immunizing with the PSMGFR peptide. FIG. 84B and FIG. 84E show the FACS graph of antibodies that were generated by immunizing with the N+20/C-27 peptide. FIG. 84C and FIG. 84F show the FACS graph of antibodies that were generated by immunizing with the N+9/C-9 peptide. FIG. 84G shows the PSMGFR sequence that is extended at the N-terminus by 20 amino acids. Figure discloses SEQ ID NO: 822.

Figures 85A, 85B, 85C, 85D, 85E, 85F, 85G:
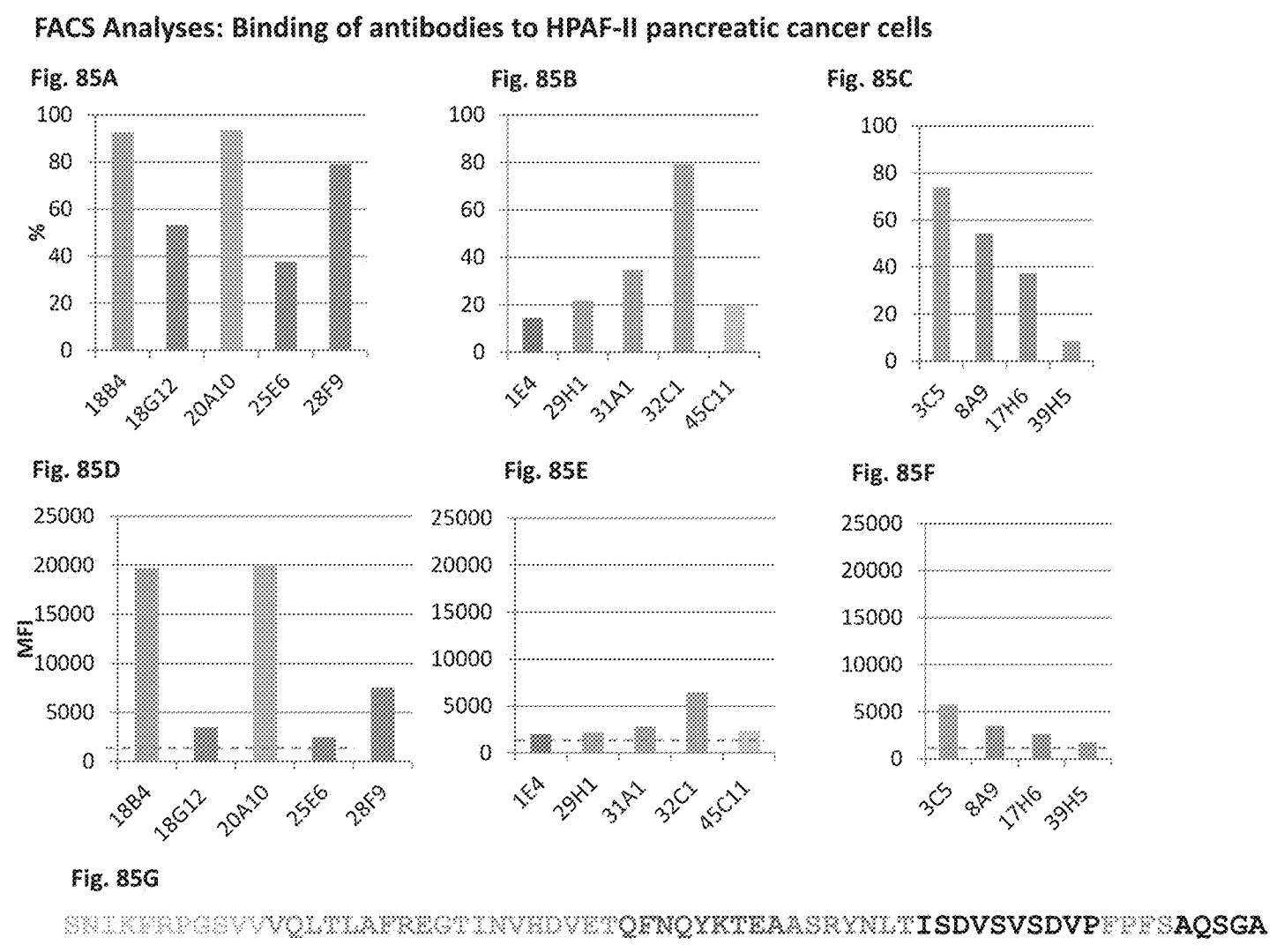

FIG. 85A-85G shows color coded graphs that resulted from FACS analyses of each antibody binding to HPAF-II pancreatic cancer cells and their respective cognate sequences within the N-terminally extended PSMGFR sequence. FIG. 85A-85C are FACS graphs showing the percent cells that were recognized by each antibody. FIG. 85D-85F are FACS graphs showing the Mean Fluorescence Intensity, MFI, of each antibody. FIG. 85A and FIG. 85D show the FACS graph of antibodies that were generated by immunizing with the PSMGFR peptide. FIG. 85B and FIG. 85E show the FACS graph of antibodies that were generated by immunizing with the N+20/C-27 peptide. FIG. 85C and FIG. 85F show the FACS graph of antibodies that were generated by immunizing with the N+9/C-9 peptide. FIG. 85G shows the PSMGFR sequence that is extended at the N-terminus by 20 amino acids. Figure discloses SEQ ID NO: 822.

FIG. 86A-86G shows color coded graphs that resulted from FACS analyses of each antibody binding to Capan-1 pancreatic cancer cells and their respective cognate sequences within the N-terminally extended PSMGFR sequence. FIG. 86A-86C are FACS graphs showing the percent cells that were recognized by each antibody. FIG. 86D-86F are FACS graphs showing the Mean Fluorescence Intensity, MFI, of each antibody. FIG. 86A and FIG. 86D show the FACS graph of antibodies that were generated by immunizing with the PSMGFR peptide. FIG. 86B and FIG. 86E show the FACS graph of antibodies that were generated by immunizing with the N+20/C-27 peptide. FIG. 86C and FIG. 86F show the FACS graph of antibodies that were generated by immunizing with the N+9/C-9 peptide. FIG. 86G shows the PSMGFR sequence that is extended at the N-terminus by 20 amino acids. Figure discloses SEQ ID NO: 822.

FIG. 87A-87G shows color coded graphs that resulted from FACS analyses of each antibody binding to MDA-MB-231 breast cancer cells, which are nearly MUC1 negative, and their respective cognate sequences within the N-terminally extended PSMGFR sequence. FIG. 87A-87C are FACS graphs showing the percent cells that were recognized by each antibody. FIG. 87D-87F are FACS graphs showing the Mean Fluorescence Intensity, MFI, of each antibody. FIG. 87A and FIG. 87D show the FACS graph of antibodies that were generated by immunizing with the PSMGFR peptide. FIG. 87B and FIG. 87E show the FACS graph of antibodies that were generated by immunizing with the N+20/C-27 peptide. FIG. 87C and FIG. 87F show the FACS graph of antibodies that were generated by immunizing with the N+9/C-9 peptide. FIG. 87G shows the PSMGFR sequence that is extended at the N-terminus by 20 amino acids. Figure discloses SEQ ID NO: 822.

FIG. 88A-88L show photographs of normal liver tissue specimens, each from the same donor but stained with a different antibody of the invention. FIG. 88A-88F show the entire tissue core. FIG. 88G-88L show the 40× magnification of a particular area of the tissue. The tissues are ordered from right to left with antibodies that bind to the most membrane proximal, that is to say most C-terminal portion of the PSMGFR peptide, on the right and antibodies that bind to the most N-terminal portions of the MUC1 extra cellular domain, even beyond the PSMGFR region, on the left. As can be seen in the figure, the most cancer-specific antibodies are those that bind to the more membrane proximal portions of the PSMGFR sequence and antibodies that bind to the most distal, N-terminal portions lose cancer specificity, with those antibodies that bind to epitopes outside of the PSMGFR having lost all cancer specificity. Figure discloses SEQ ID NOS 822, 1744, 1750, 1746, 1749, 1745, and 1743, respectively, in order of appearance.

FIGS. 89-112: IHC of critical organs organized by antibody epitope. The specimens are from FDA Normal tissue array MN88021.

FIG. 89A-89H show photographs of normal heart tissue specimens, stained with different antibodies of the invention. FIG. 89A-89D show the entire tissue core. FIG. 89E-89HL show the 40× magnification of a particular area of the tissue. FIG. 89A and FIG. 89E show staining with 50 ug/mL MNC2-scFv. FIG. 89B and FIG. 89F show staining with 2.5 ug/mL MNE6. FIG. 89C and FIG. 89G show staining with 0.25 ug/mL 20A10. FIG. 89D and FIG. 89H show staining with 20 ug/mL 3C2B1. These antibodies bind to N-10 but not C-10 and bind to an epitope that comprises all or part of the sequence FPFS (SEQ ID NO: 1747) or PFPFSAQSGA (SEQ ID NO: 1743), which are critical for antibody binding. All these antibodies are all able to bind to the PSMGFR peptide, bind to the N-10 peptide but do not bind to the C-10 peptide. In addition, these antibodies disrupt the binding of NME7$_{AB}$ to the MUC1* extra cellular domain as exemplified by the PSMGFR peptide. Further, these antibodies recognize a MUC1 cleavage product when the cleavage enzyme is MMP9. As can be seen in the figure, these antibodies show no binding to normal heart tissue.

Figures 90A, 90B, 90C, 90D:
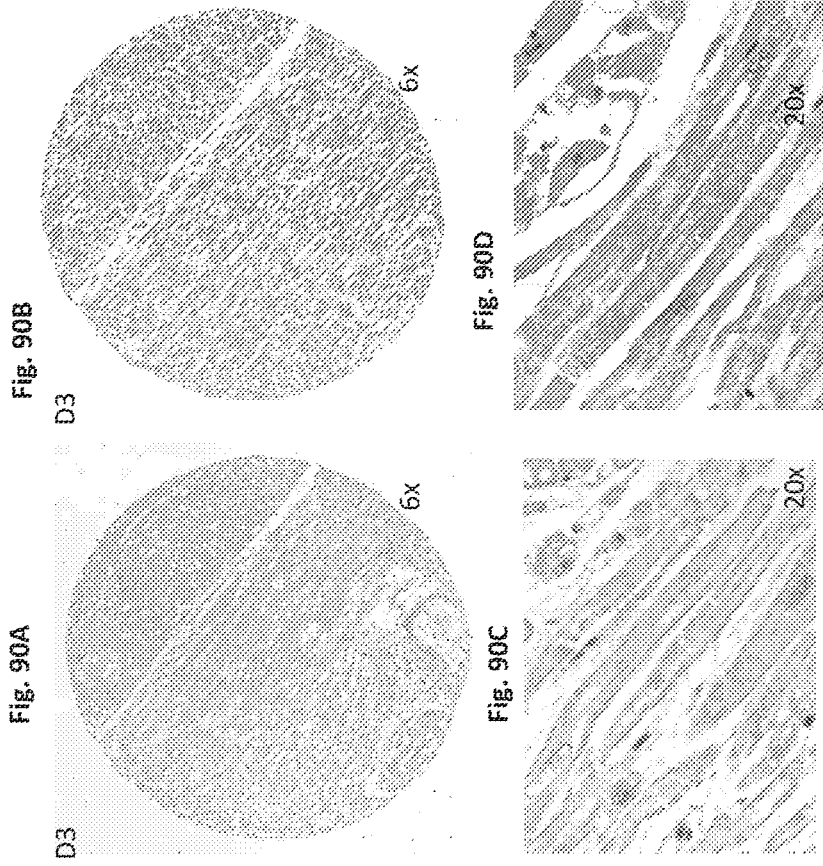

FIG. 90A-90D show photographs of normal heart tissue specimens, stained with different antibodies of the invention. FIG. 90A-90B show the entire tissue core. FIG. 90C-90D show the 40× magnification of a particular area of the tissue. FIG. 90A and FIG. 90C show staining with 5 ug/mL MNC3. FIG. 90B and FIG. 90D show staining with 5 ug/mL 25E6. These antibodies bind to N-10 but also bind C-10 and bind to an epitope that comprises all or part of the sequence ASRYNLT (SEQ ID NO: 1745). These antibodies are all able to bind to the PSMGFR peptide, bind to the N-10 peptide but also bind to the C-10 peptide.

Figures 91A, 91B:
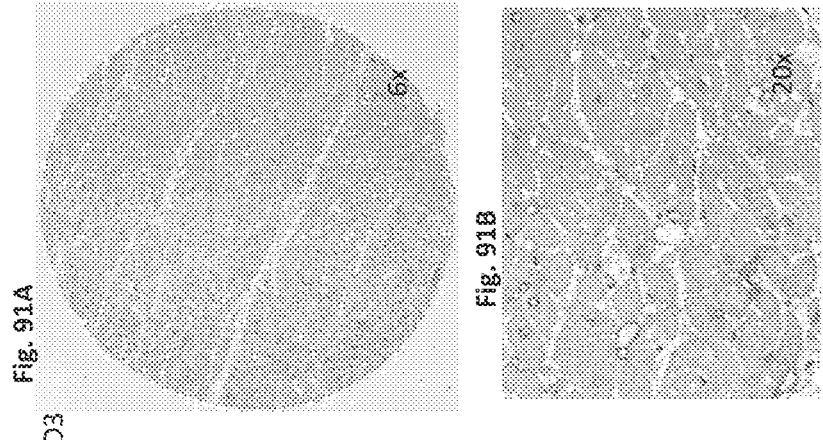

FIG. 91A-91B show photographs of normal heart tissue specimens, stained with an antibody of the invention 1E4. FIG. 91A show the entire tissue core. FIG. 91B show the 40× magnification of a particular area of the tissue. Antibody 1E4 binds to an epitope that comprises all or part of the sequence QFNQYKTEA (SEQ ID NO: 1749). Antibody 1E4 (7.5 ug/mL) can bind to the N-10 peptide but also binds to the C-10 peptide. As can be seen in the figure, 1E4 binds to normal heart tissue.

FIG. 92A-92H show photographs of normal heart tissue specimens, stained with different antibodies of the invention. FIG. 92A-92D show the entire tissue core. FIG. 92E-92HL show the 40× magnification of a particular area of the tissue. FIG. 92A and FIG. 92E show staining with 10 ug/mL 18B4. FIG. 92B and FIG. 92F show staining with 0.5 ug/mL 31A1. FIG. 92C and FIG. 92G show staining with 0.25 ug/mL 32C1. FIG. 92D and FIG. 92H show staining with 0.5 ug/mL 29H1. These antibodies bind to N-10 but can bind to C-10 and bind to an epitope that comprises all or part of the sequence GTINVHDVET (SEQ ID NO: 1746), which is the most N-terminal part of the PSMGFR peptide. None of these antibodies are able to bind to the N-10 peptide. As can be seen in the figure, all of these antibodies except 18B4 bind to normal heart tissue.

FIG. 93A-93D show photographs of normal heart tissue specimens, stained with antibodies of the invention. FIG. 93A-93B show the entire tissue core. FIG. 93C-93D show the 40× magnification of a particular area of the tissue. FIG.

93A and FIG. 93C show staining with antibody 15 ug/mL 8A9. FIG. 93B and FIG. 93D show staining with antibody 30 ug/mL 17H6. Both antibodies bind to an epitope that that is outside of, and N-terminal to, the PSMGFR region and comprises all or part of the sequence VQLTLAFRE (SEQ ID NO: 1750). As can be seen in the figure, both antibodies show strong binding to normal heart tissue.

Figures 94A, 94B:
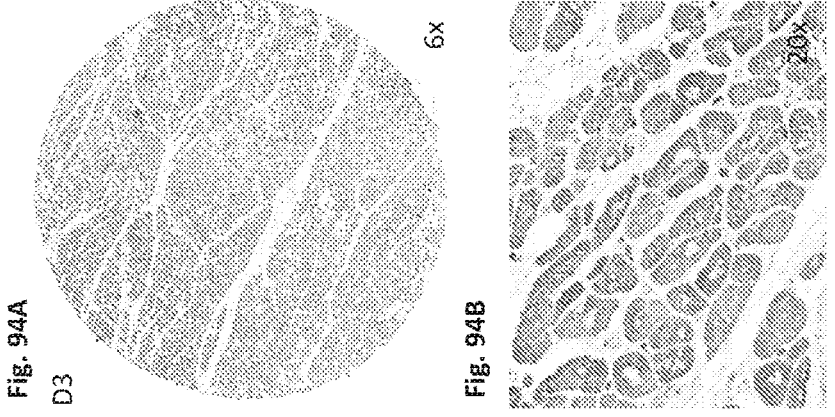

FIG. 94A-94B show photographs of normal heart tissue specimens, stained with an antibody of the invention 45C11. FIG. 94A show the entire tissue core. FIG. 94B show the 40× magnification of a particular area of the tissue. Antibody 45C11 (12.5 ug/mL) binds to an epitope that is outside of, and N-terminal to, the PSMGFR region and comprises all or part of the sequence SNIKFRPGSVV (SEQ ID NO: 1744). Antibody 45C11 cannot bind to the N-10 peptide. As can be seen in the figure, 45C11 binds strongly to normal heart tissue.

FIG. 95A-95H show photographs of normal liver tissue specimens, stained with different antibodies of the invention. FIG. 95A-95D show the entire tissue core. FIG. 95E-95HL show the 40× magnification of a particular area of the tissue. FIG. 95A and FIG. 95E show staining with 50 ug/mL MNC2-scFv. FIG. 95B and FIG. 95F show staining with 2.5 ug/mL MNE6. FIG. 95C and FIG. 95G show staining with 0.25 ug/mL 20A10. FIG. 95D and FIG. 95H show staining with 20 ug/mL 3C2B1. These antibodies bind to N-10 but not C-10 and bind to an epitope that comprises all or part of the sequence FPFS (SEQ ID NO: 1747) or PFPFSAQSGA (SEQ ID NO: 1743). All these antibodies are all able to bind to the PSMGFR peptide, bind to the N-10 peptide but do not bind to the C-10 peptide. In addition, these antibodies disrupt the binding of NME7$_{AB}$ to the MUC1* extra cellular domain as exemplified by the PSMGFR peptide. Further, these antibodies recognize a MUC1 cleavage product when the cleavage enzyme is MMP9. As can be seen in the figure, these antibodies show no binding to normal liver tissue.

FIG. 96A-96D show photographs of normal liver tissue specimens, stained with different antibodies of the invention. FIG. 96A-96B show the entire tissue core. FIG. 96C-96D show the 40× magnification of a particular area of the tissue. FIG. 96A and FIG. 96C show staining with MNC3. FIG. 96B and FIG. 96D show staining with 25E6. These antibodies bind to N-10 but also bind C-10 and bind to an epitope that comprises all or part of the sequence ASRYNLT (SEQ ID NO: 1745). These antibodies are all able to bind to the PSMGFR peptide, bind to the N-10 peptide but also bind to the C-10 peptide.

Figures 97A, 97B:
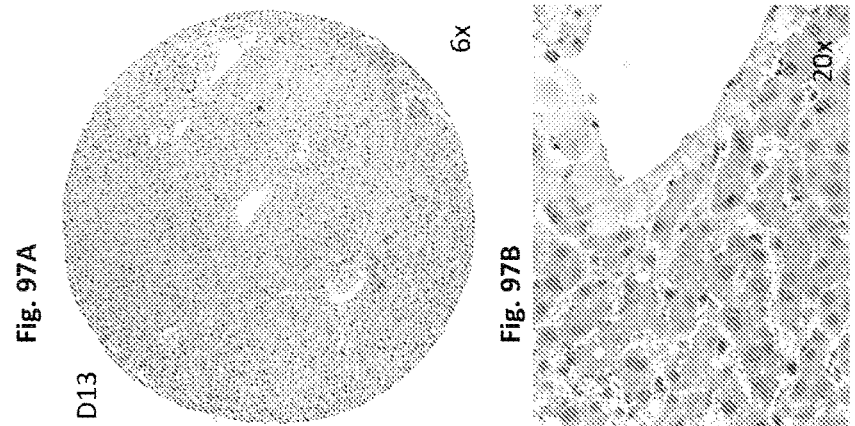

FIG. 97A-97B show photographs of normal liver tissue specimens, stained with an antibody of the invention 1E4. FIG. 97A show the entire tissue core. FIG. 97B show the 40× magnification of a particular area of the tissue. Antibody 1E4 binds to an epitope that comprises all or part of the sequence QFNQYKTEA (SEQ ID NO: 1749). Antibody (7.5 ug/mL) 1E4 can bind to the N-10 peptide but also binds to the C-10 peptide. As can be seen in the figure, 1E4 binds to normal liver tissue.

FIG. 98A-98H show photographs of normal liver tissue specimens, stained with different antibodies of the invention. FIG. 98A-98D show the entire tissue core. FIG. 98E-98H show the 40× magnification of a particular area of the tissue. FIG. 98A and FIG. 98E show staining with 10 ug/mL 18B4. FIG. 98B and FIG. 98F show staining with 0.5 ug/mL 31A1. FIG. 98C and FIG. 98G show staining with 0.25 ug/mL 32C1. FIG. 98D and FIG. 98H show staining with 0.5 ug/mL 29H1. These antibodies bind to an epitope that comprises all or part of the sequence GTINVHDVET (SEQ ID NO: 1746), which is the most N-terminal part of the PSMGFR peptide.

None of these antibodies are able to bind to the N-10 peptide. As can be seen in the figure, 32C1 shows some binding to normal liver and 29H1 shows extremely strong binding to normal liver tissue.

FIG. 99A-99D show photographs of normal liver tissue specimens, stained with antibodies of the invention. FIG. 99A-99B show the entire tissue core. FIG. 99C-99D show the 40× magnification of a particular area of the tissue. FIG. 99A and FIG. 99C show staining with antibody 15 ug/mL 8A9. FIG. 99B and FIG. 99D show staining with 30 ug/mL antibody 17H6. Both antibodies bind to an epitope that that is outside of the PSMGFR region and comprises all or part of the sequence VOLTLAFRE (SEQ ID NO: 1750). As can be seen in the figure, 8A9 shows strong binding to normal liver tissue. 17H6 is a weak antibody and it is possible that it was not used at a high enough concentration in this study.

Figures 100A, 100B:
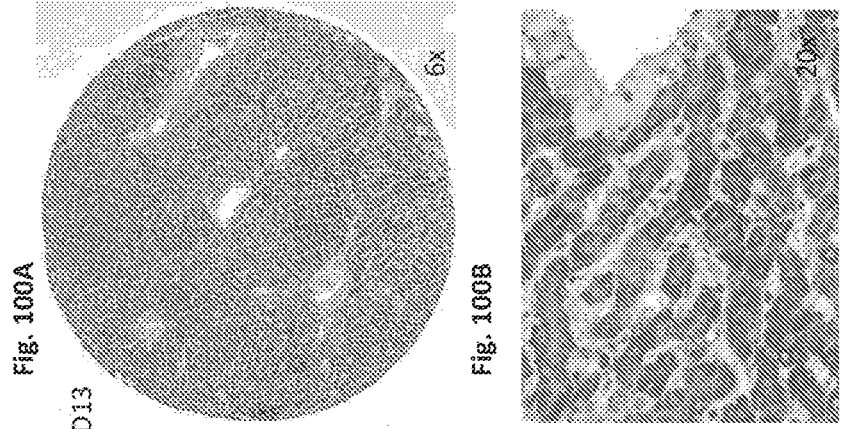

FIG. 100A-100B show photographs of normal liver tissue specimens, stained with an antibody of the invention 45C11. FIG. 100A show the entire tissue core. FIG. 100B show the 40× magnification of a particular area of the tissue. Antibody 45C11 binds to an epitope that is outside of the PSMGFR region and comprises all or part of the sequence SNIKFRPGSVV (SEQ ID NO: 1744). Antibody 45C11 cannot bind to the N-10 peptide. As can be seen in the figure, 12.5 ug/mL 45C11 binds strongly to normal liver tissue.

FIG. 101A-101H show photographs of normal lung tissue specimens, stained with different antibodies of the invention. FIG. 101A-101D show the entire tissue core. FIG. 101E-101H show the 40× magnification of a particular area of the tissue. FIG. 101A and FIG. 101E show staining with 50 ug/mL MNC2-scFv. FIG. 101B and FIG. 101F show staining with 2.5 ug/mL MNE6. FIG. 101C and FIG. 101G show staining with 0.25 ug/mL 20A10. FIG. 101D and FIG. 101H show staining with 20 ug/mL 3C2B1. These antibodies bind to an epitope that comprises all or part of the sequence FPFS (SEQ ID NO: 1747) or PFPFSAQSGA (SEQ ID NO: 1743). All these antibodies are all able to bind to the PSMGFR peptide, bind to the N-10 peptide but do not bind to the C-10 peptide. In addition, these antibodies disrupt the binding of NME7$_{AB}$ to the MUC1* extra cellular domain as exemplified by the PSMGFR peptide. Further, these antibodies recognize a MUC1 cleavage product when the cleavage enzyme is MMP9. As can be seen in the figure, these antibodies show no binding to normal lung tissue. Figure discloses "FPFS" as SEQ ID NO: 1747.

FIG. 102A-102D show photographs of normal lung tissue specimens, stained with different antibodies of the invention. FIG. 102A-102B show the entire tissue core. FIG. 102C-102D show the 40× magnification of a particular area of the tissue. FIG. 102A and FIG. 102C show staining with 5 ug/mL MNC3. FIG. 102B and FIG. 102D show staining with 5 ug/mL 25E6. These antibodies bind to an epitope that comprises all or part of the sequence ASRYNLT (SEQ ID NO: 1745). These antibodies are all able to bind to the PSMGFR peptide, bind to the N-10 peptide but also bind to the C-10 peptide.

Figures 103A, 103B:
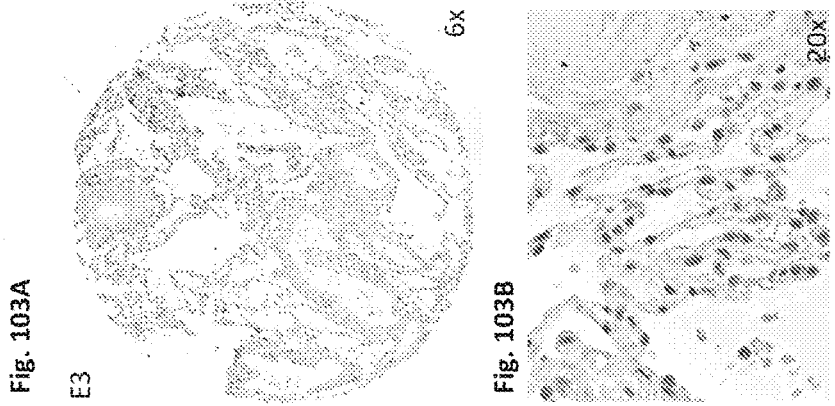

FIG. 103A-103B show photographs of normal lung tissue specimens, stained with an antibody of the invention 1E4 (7.5 ug/mL). FIG. 103A show the entire tissue core. FIG. 103B show the 40× magnification of a particular area of the tissue. Antibody 1E4 binds to an epitope that comprises all or part of the sequence QFNQYKTEA (SEQ ID NO: 1749). Antibody 1E4 can bind to the N-10 peptide but also binds to the C-10 peptide.

Figures 104E, 104F, 104G, 104H:
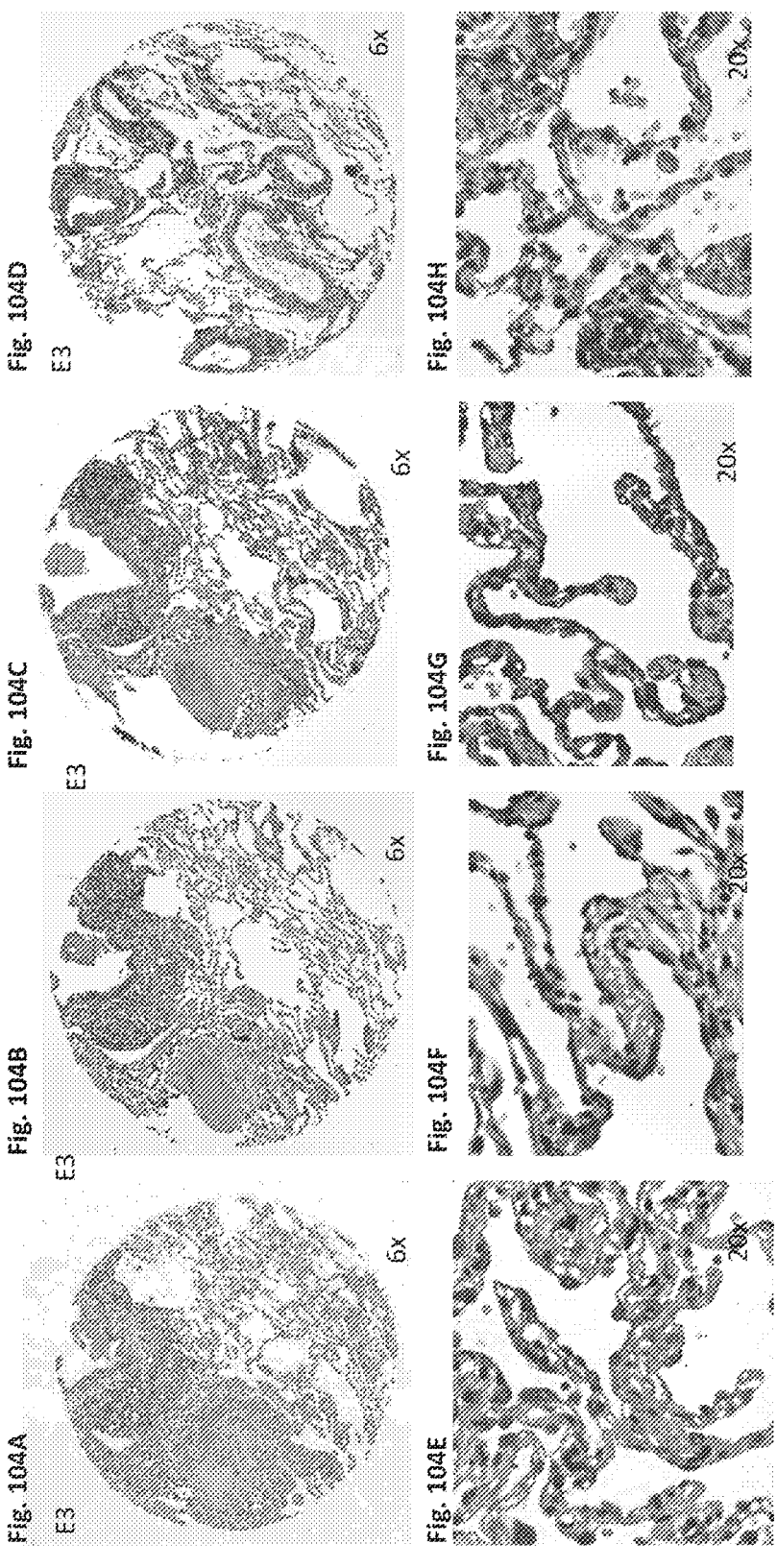

FIG. 104A-104H show photographs of normal lung tissue specimens, stained with different antibodies of the invention. FIG. 104A-104D show the entire tissue core. FIG. 104E-

104H show the 40× magnification of a particular area of the tissue. FIG. 104A and FIG. 104E show staining with 10 ug/mL 18B4. FIG. 104B and FIG. 104F show staining with 0.5 ug/mL 31A1. FIG. 104C and FIG. 104G show staining with 0.25 ug/mL 32C1. FIG. 104D and FIG. 104H show staining with 0.5 ug/mL 29H1. These antibodies bind to an epitope that comprises all or part of the sequence GTINVHDVET (SEQ ID NO: 1746), which is the most N-terminal part of the PSMGFR peptide. None of these antibodies are able to bind to the N-10 peptide. As can be seen in the figure, all these antibodies show strong binding to normal lung tissue.

Figures 105A, 105B, 105C, 105D:
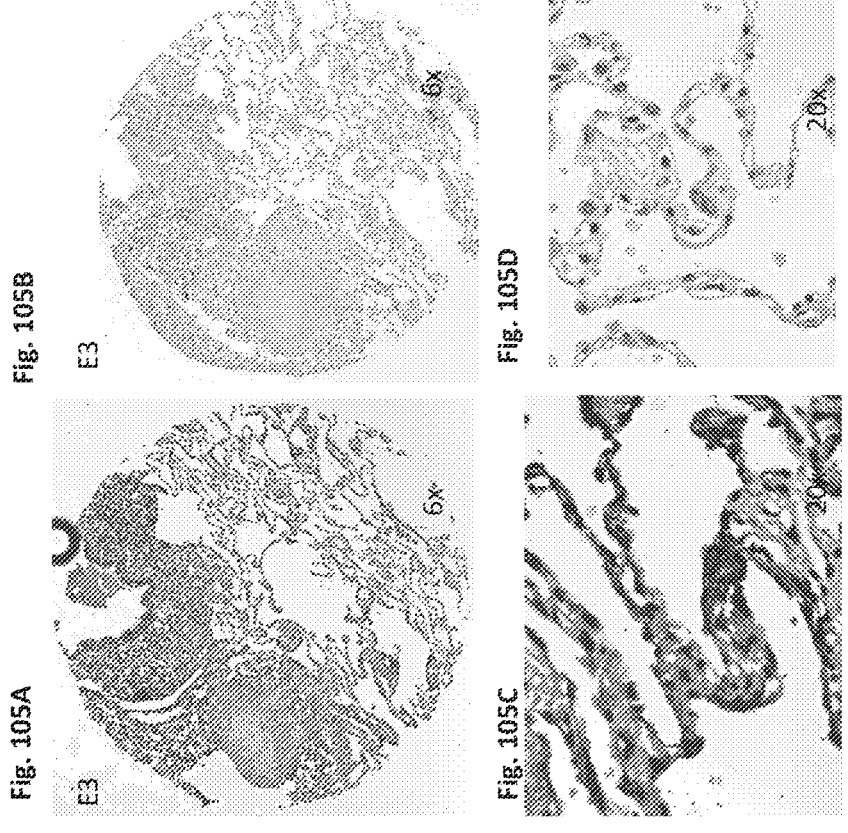

FIG. 105A-105D show photographs of normal lung tissue specimens, stained with antibodies of the invention. FIG. 105A-105B show the entire tissue core. FIG. 105C-105D show the 40× magnification of a particular area of the tissue. FIG. 105A and FIG. 105C show staining with 15 ug/mL antibody 8A9. FIG. 105B and FIG. 105D show staining with 30 ug/mL antibody 17H6. Both antibodies bind to an epitope that that is outside of the PSMGFR region and comprises all or part of the sequence VQLTLAFRE (SEQ ID NO: 1750). As can be seen in the figure, 8A9 shows strong binding to normal lung tissue. 17H6 is a weak antibody and it is possible that it was not used at a high enough concentration in this study.

Figures 106A, 106B:
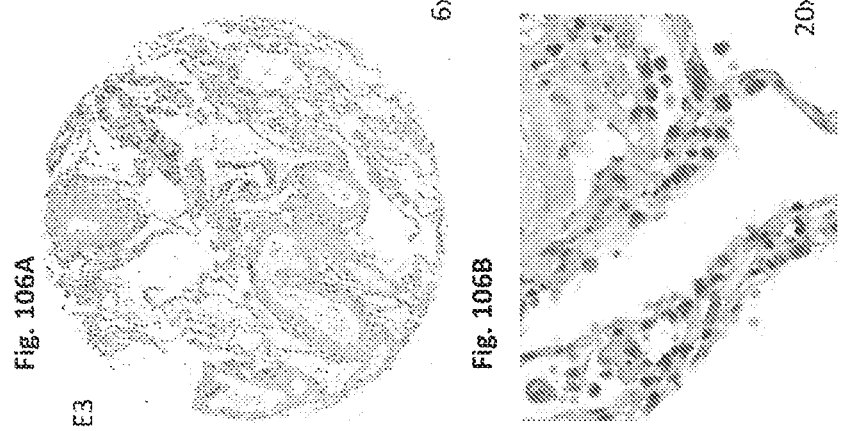

FIG. 106A-106B show photographs of normal lung tissue specimens, stained with an antibody of the invention 45C11 (12.5 ug/mL). FIG. 106A show the entire tissue core. FIG. 106B show the 40× magnification of a particular area of the tissue. Antibody 45C11 binds to an epitope that is outside of the PSMGFR region and comprises all or part of the sequence SNIKFRPGSVV (SEQ ID NO: 1744). Antibody 45C11 cannot bind to the N-10 peptide. As can be seen in the figure, 45C11 binds to normal lung tissue.

FIG. 107A-107H show photographs of normal bone marrow tissue specimens, stained with different antibodies of the invention. FIG. 107A-107D show the entire tissue core.

FIG. 107E-107H show the 40× magnification of a particular area of the tissue. FIG. 107A and FIG. 107E show staining with 50 ug/mL MNC2-scFv. FIG. 107B and FIG. 107F show staining with 2.5 ug/mL MNE6. FIG. 107C and FIG. 107G show staining with 0.25 ug/mL 20A10. FIG. 107D and FIG. 107H show staining with 20 ug/mL 3C2B1. These antibodies bind to an epitope that comprises all or part of the sequence FPFS (SEQ ID NO: 1747) or PFPFSAQSGA (SEQ ID NO: 1743). All these antibodies are all able to bind to the PSMGFR peptide, bind to the N-10 peptide but do not bind to the C-10 peptide. In addition, these antibodies disrupt the binding of NIME7$_{AB}$ to the MUC1* extra cellular domain as exemplified by the PSMGFR peptide. Further, these antibodies recognize a MUC1 cleavage product when the cleavage enzyme is MMP9. As can be seen in the figure, these antibodies show no binding to normal bone marrow tissue. Figure discloses "FPFS" as SEQ ID NO: 1747.

FIG. 108A-108D show photographs of normal bone marrow tissue specimens, stained with different antibodies of the invention. FIG. 108A-108B show the entire tissue core. FIG. 108C-108D show the 40× magnification of a particular area of the tissue. FIG. 108A and FIG. 108C show staining with 5 ug/mL MNC3. FIG. 108B and FIG. 108D show staining with 5 ug/mL 25E6. These antibodies bind to an epitope that comprises all or part of the sequence ASRYNLT (SEQ ID NO: 1745). These antibodies are all able to bind to the PSMGFR peptide, bind to the N-10 peptide but also bind to the C-10 peptide.

Figures 109A, 109B:
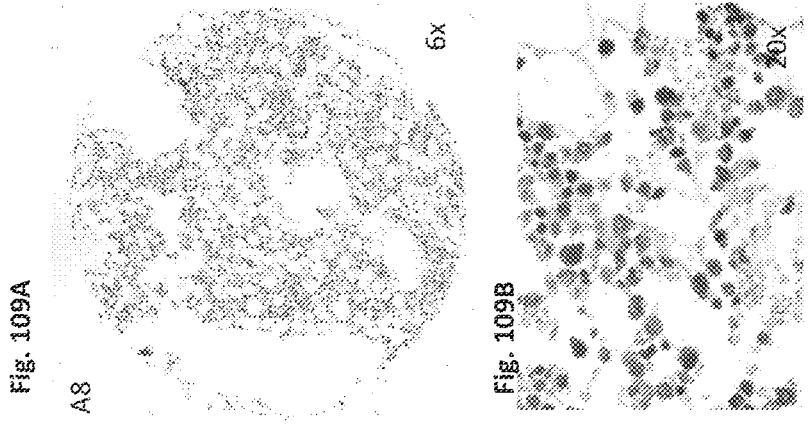

FIG. 109A-109B show photographs of normal bone marrow tissue specimens, stained with an antibody of the invention 1E4 (7.5 ug/mL). FIG. 109A show the entire tissue core. FIG. 109B show the 40× magnification of a particular area of the tissue. Antibody 1E4 binds to an epitope that comprises all or part of the sequence QFNQYKTEA (SEQ ID NO: 1749). Antibody 1E4 can bind to the N-10 peptide but also binds to the C-10 peptide. 1E4 binds to normal bone marrow.

FIG. 110A-110H show photographs of normal bone marrow tissue specimens, stained with different antibodies of the invention. FIG. 110A-110D show the entire tissue core. FIG. 110E-110H show the 40× magnification of a particular area of the tissue. FIG. 110A and FIG. 110E show staining with 10 ug/mL 18B4. FIG. 110B and FIG. 110F show staining with 0.5 ug/mL 31A1. FIG. 110C and FIG. 110G show staining with 0.25 ug/mL 32C1. FIG. 110D and FIG. 110H show staining with 0.5 ug/mL 29H1. These antibodies bind to an epitope that comprises all or part of the sequence GTINVHDVET (SEQ ID NO: 1746), which is the most N-terminal part of the PSMGFR peptide. None of these antibodies are able to bind to the N-10 peptide. As can be seen in the figure, all these antibodies show strong binding to normal bone marrow tissue.

Figures 111A, 111B, 111C, 111D:
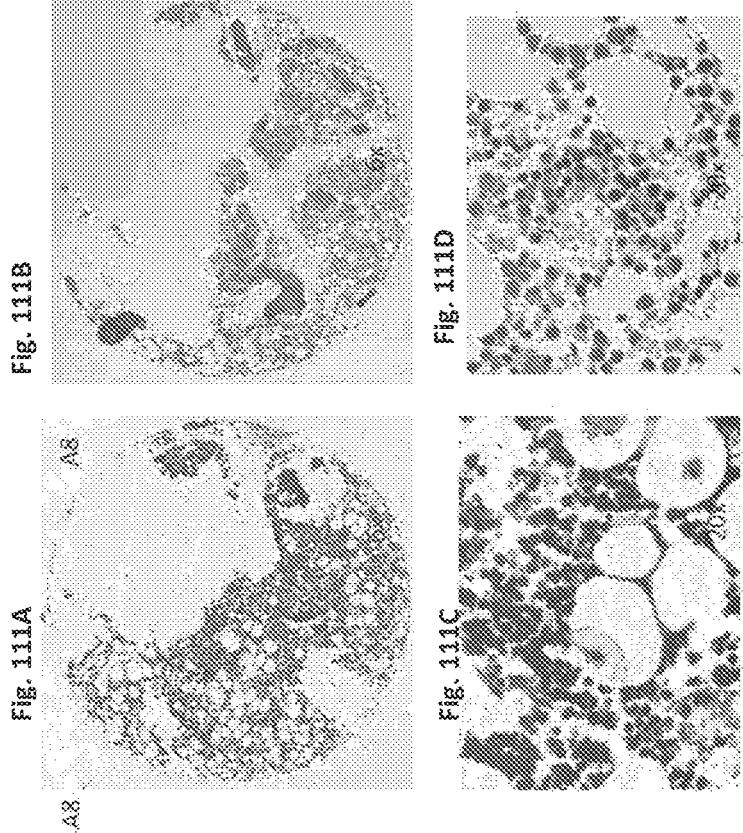

FIG. 111A-111D show photographs of normal bone marrow tissue specimens, stained with antibodies of the invention. FIG. 111A-111B show the entire tissue core. FIG. 111C-111D show the 40× magnification of a particular area of the tissue. FIG. 111A and FIG. 111C show staining with antibody 15 ug/mL 8A9. FIG. 111B and FIG. 111D show staining with antibody 30 ug/mL 17H6. Both antibodies bind to an epitope that that is outside of the PSMGFR region and comprises all or part of the sequence VQLTLAFRE (SEQ ID NO: 1750). As can be seen in the figure, 8A9 shows strong binding to normal bone marrow tissue. 17H6 is a weak antibody and it is possible that it was not used at a high enough concentration in this study.

Figures 112A, 112B:
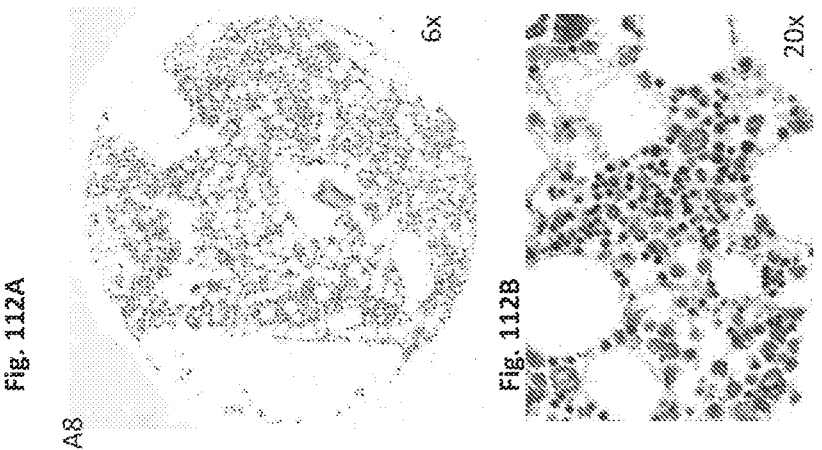

FIG. 112A-112B show photographs of normal bone marrow tissue specimens, stained with an antibody of the invention 45C11 (12.5 ug/mL). FIG. 112A show the entire tissue core. FIG. 112B show the 40× magnification of a particular area of the tissue. Antibody 45C11 binds to an epitope that is outside of the PSMGFR region and comprises all or part of the sequence SNIKFRPGSVV (SEQ ID NO: 1744). Antibody 45C11 cannot bind to the N-10 peptide. As can be seen in the figure, 45C11 binds to normal bone marrow tissue.

Figures 113A, 113B, 113C:
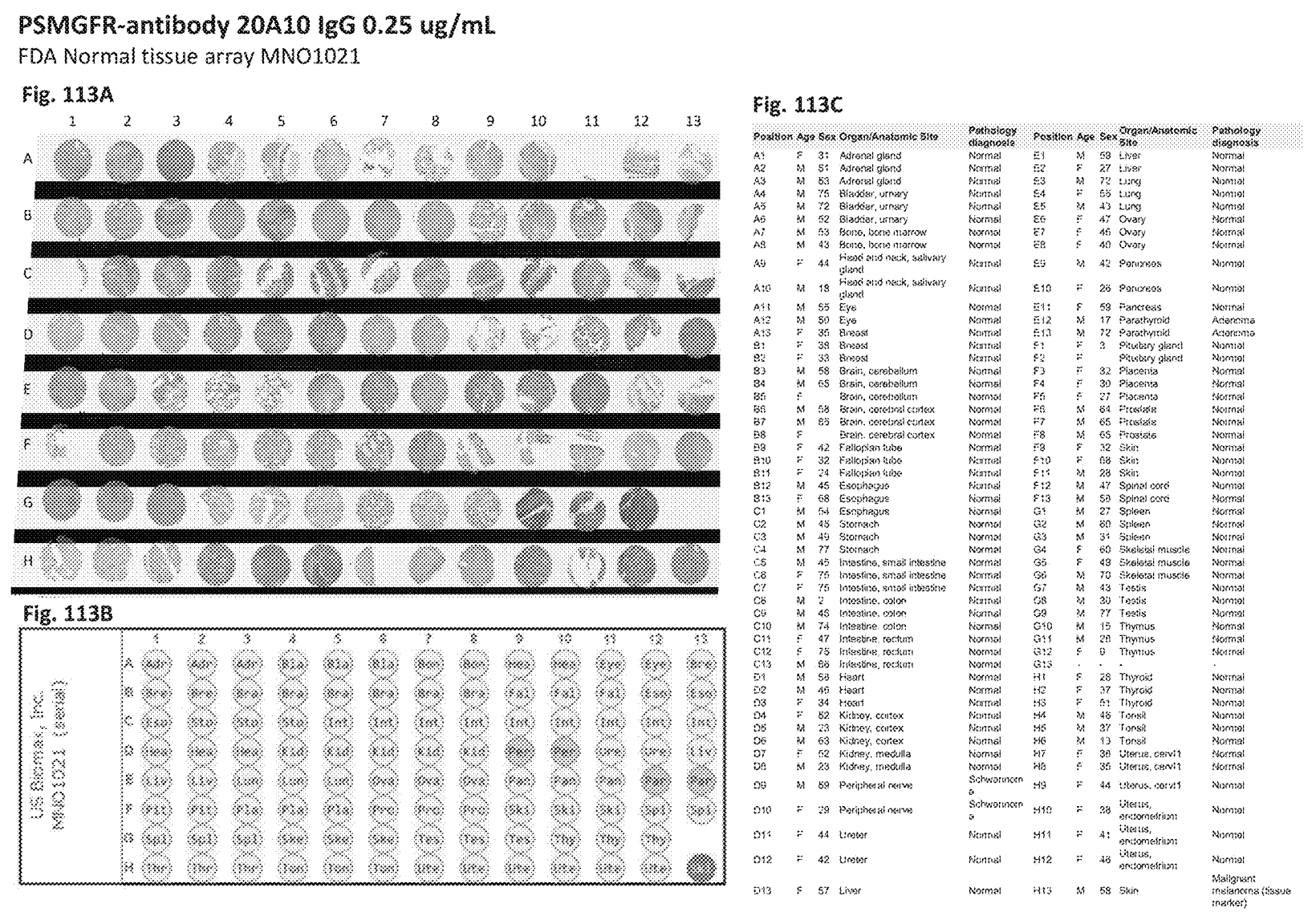

FIG. 113A-113C shows photographs, array map and description of FDA normal tissue array 1021 stained with the anti-PSMGFR antibody 20A10 at 0.25 ug/mL. FIG. 113A shows photographs of the tissue micro array. FIG. 113B shows map of the array with abbreviated tissue descriptors. FIG. 113C detailed description of the tissue micro array with non-identifying donor data.

Figures 114I, 114J, 114K, 114L, 114M, 114N, 114O, 114P:
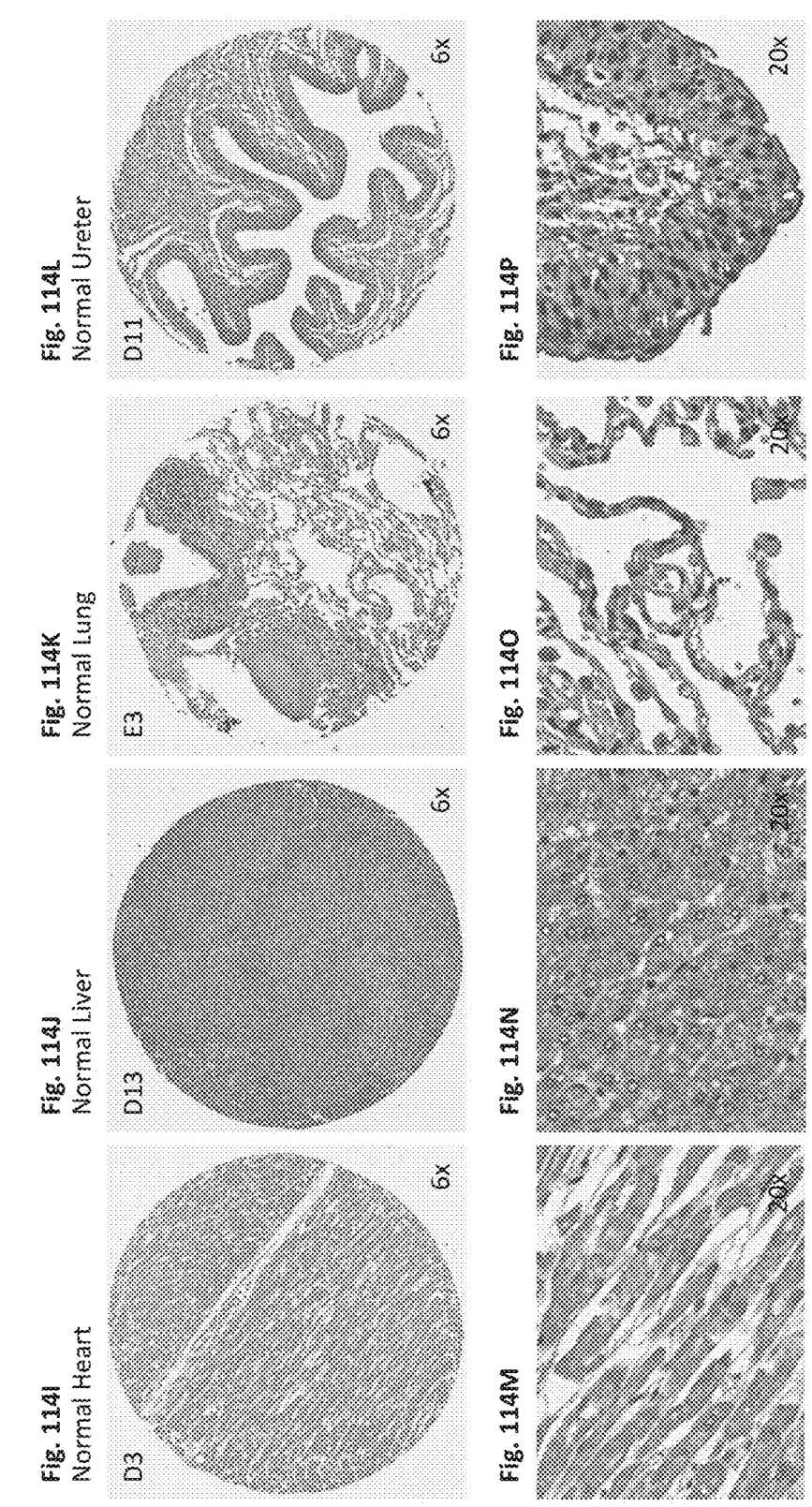
Figures 114Q, 114R, 114S, 114T, 114U, 114V, 114W, 114X:
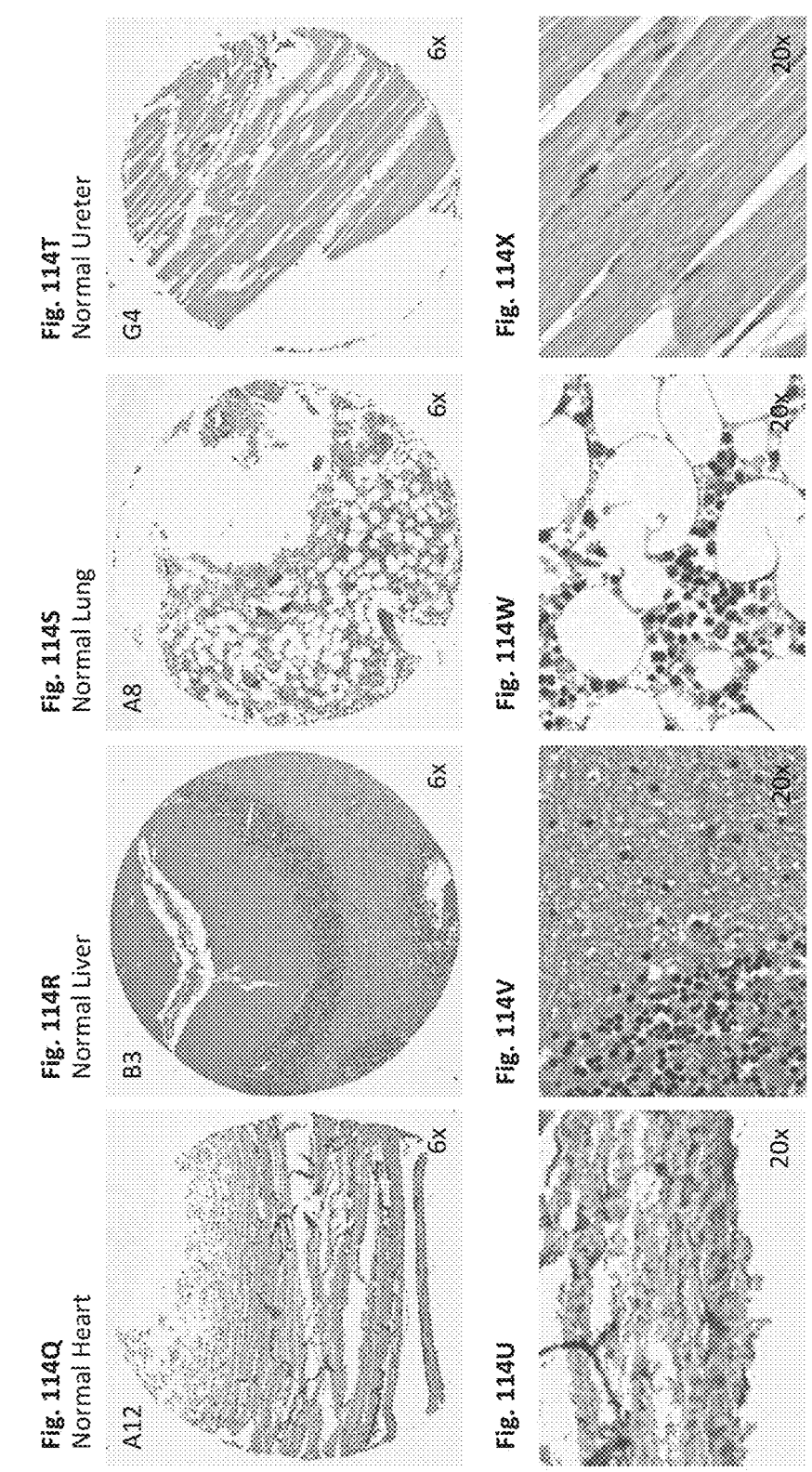

FIG. 114A-114X shows photographs of specific tissues from FDA normal tissue array 1021 stained with the anti-PSMGFR antibody 20A10 at 0.25 ug/mL, magnified to 6× and 20X. FIG. 114A and FIG. 114E are adrenal gland. FIG. 114B and FIG. 114F are breast. FIG. 114C and FIG. 114G are fallopian tube. FIG. 114D and FIG. 114H are kidney. FIG. 114I and FIG. 114M are heart muscle. FIG. 114J and FIG. 114N are liver. FIG. 114K and FIG. 114O are lung. FIG. 114L and FIG. 114P are ureter. FIG. 114Q and FIG. 114U are eye. FIG. 114R and FIG. 114V are cerebral cortex. FIG. 114S and FIG. 114W are bone marrow. FIG. 114T and FIG. 114X are skeletal muscle.

Figures 115A, 115B, 115C:
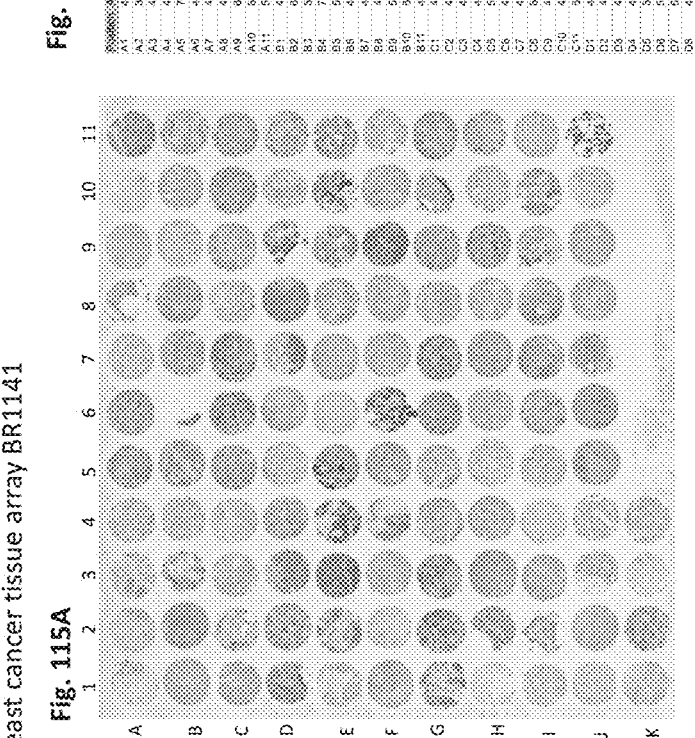

FIG. 115A-115C shows photographs, array map and description of breast cancer tissue array 1141 stained with the anti-PSMGFR antibody 20A10 at 0.25 ug/mL. FIG. 115A shows photographs of the tissue micro array. FIG. 115B shows map of the array with abbreviated tissue descriptors. FIG. 115C detailed description of the tissue micro array with non-identifying donor data.

Figures 116A, 116B, 116C, 116D, 116E, 116F:
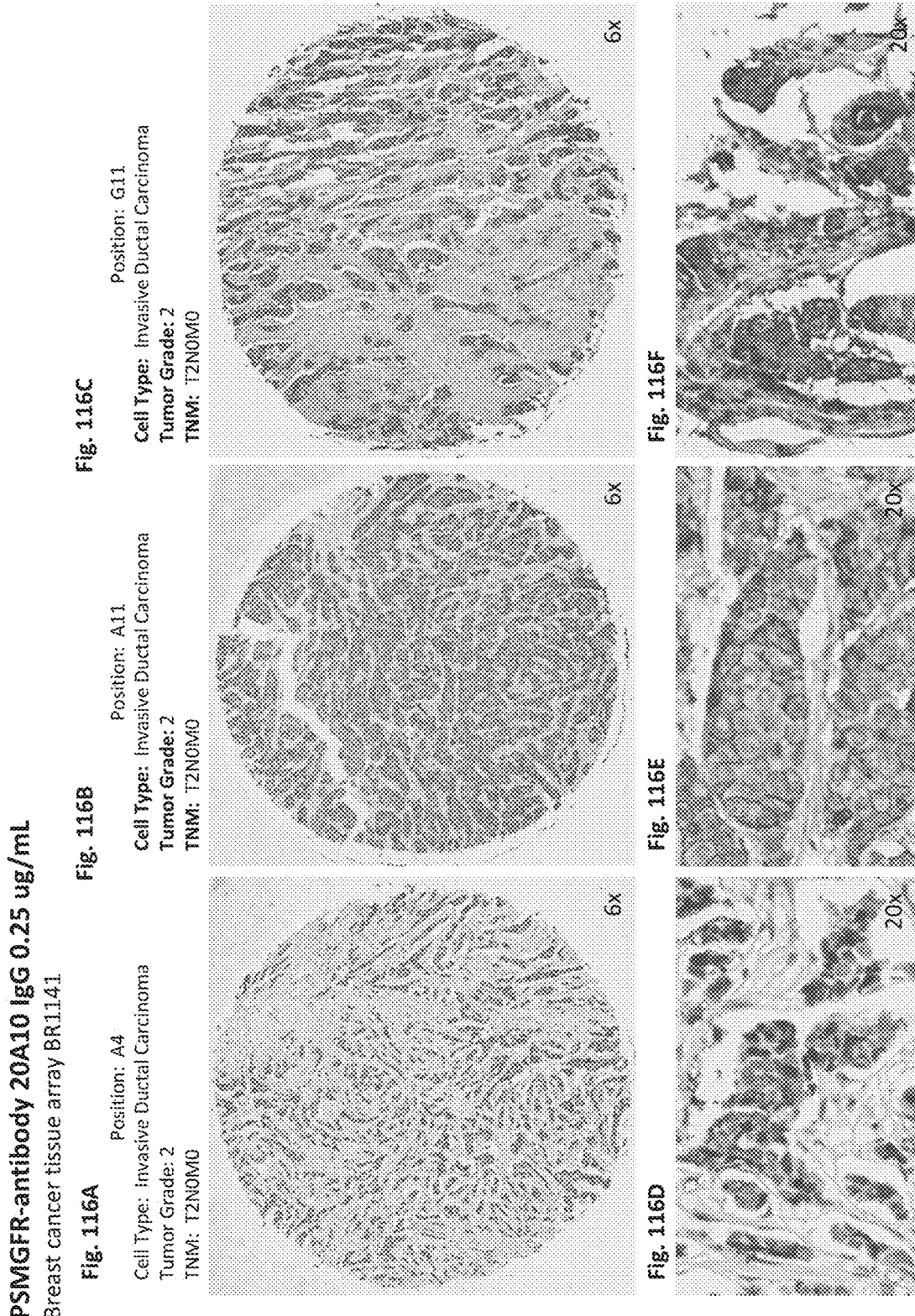

FIG. 116A-116F shows photographs of specific tissues from breast cancer tissue array 1141 stained with the anti-PSMGFR antibody 20A10 at 0.25 ug/mL, magnified to 6× and 20×. FIG. 116A and FIG. 116D are photographs of a Grade 2 invasive ductal carcinoma. FIG. 116B and FIG. 116E are photographs of a Grade 2 invasive ductal carcinoma. FIG. 116C and FIG. 116F are photographs of a Grade 2 invasive ductal carcinoma.

Figures 117A, 117B, 117C:
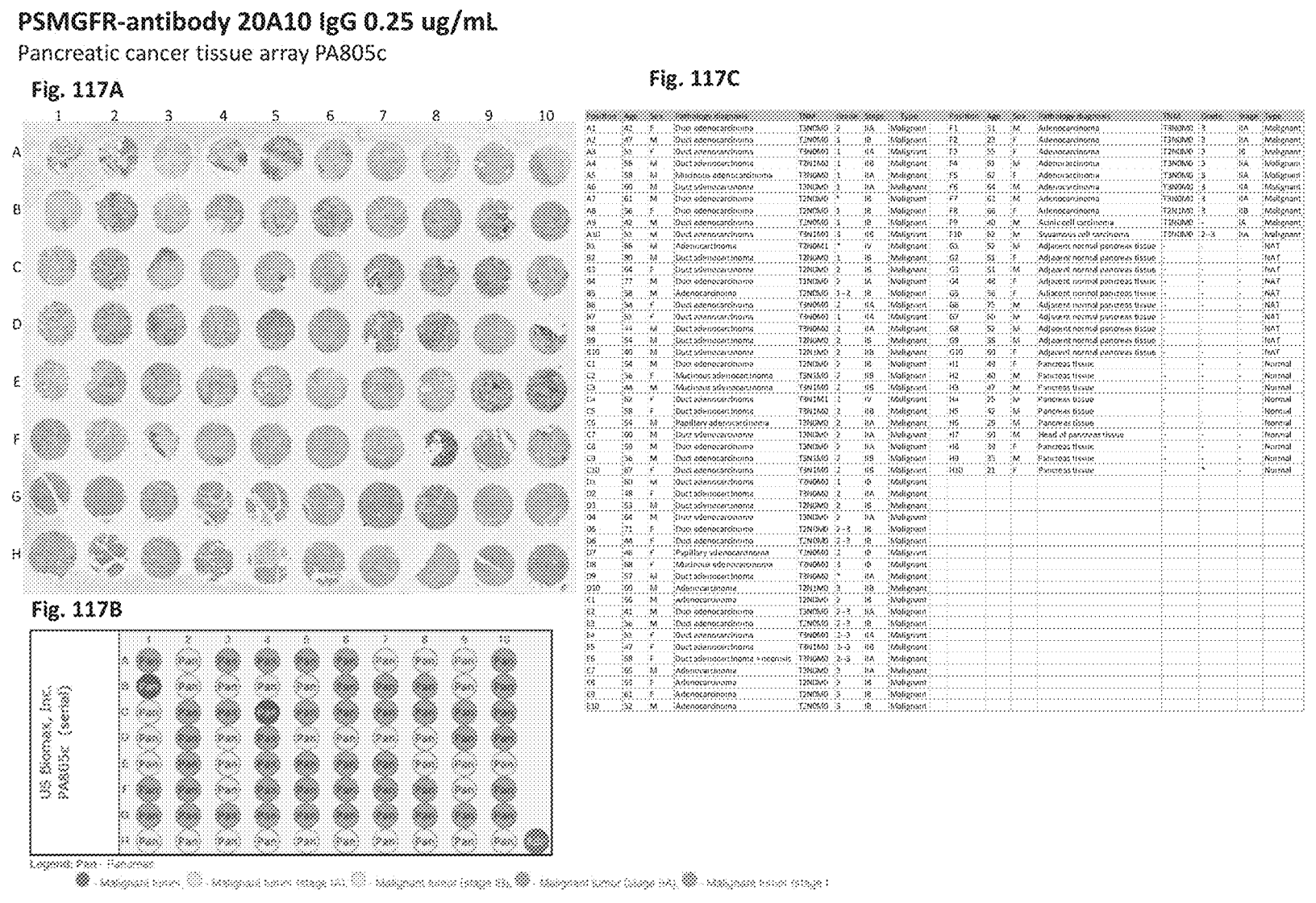

FIG. 117A-117C shows photographs, array map and description of pancreatic cancer tissue array PA805c stained with the anti-PSMGFR antibody 20A10 at 0.25 ug/mL. FIG. 117A shows photographs of the tissue micro array. FIG. 117B shows map of the array with abbreviated tissue descriptors. FIG. 117C detailed description of the tissue micro array with non-identifying donor data.

Figures 118D, 118E, 118F:
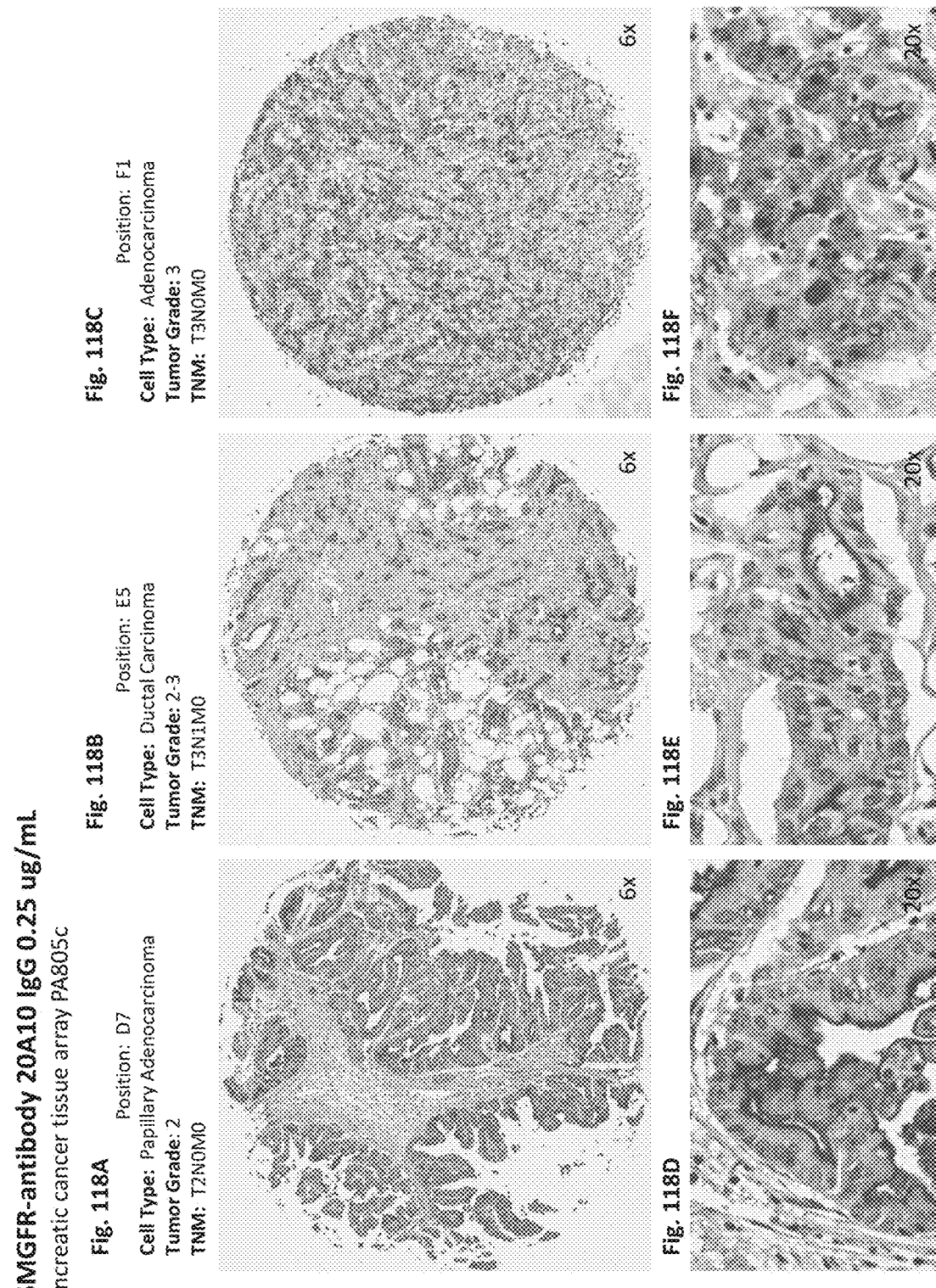

FIG. 118A-118F shows photographs of specific tissues from pancreatic cancer tissue array PA805c stained with the anti-PSMGFR antibody 20A10 at 0.25 ug/mL, magnified to 6× and 20×. FIG. 118A and FIG. 118D are photographs of a Grade 2 papillary adenocarcinoma.

FIG. 118B and FIG. 118E are photographs of a Grade 2-3 ductal carcinoma. FIG. 118C and FIG. 118F are photographs of a Grade 3 invasive adenocarcinoma.

Figures 119A, 119B, 119C:
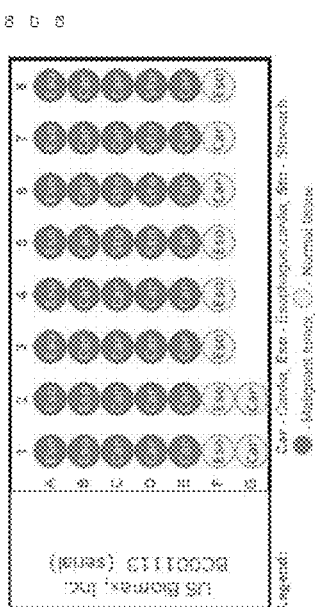

FIG. 119A-119C shows photographs, array map and description of esophageal cancer tissue array BC001113 stained with the anti-PSMGFR antibody 20A10 at 0.25 ug/mL. FIG. 119A shows photographs of the tissue micro array. FIG. 119B shows map of the array with abbreviated tissue descriptors. FIG. 119C detailed description of the tissue micro array with non-identifying donor data.

Figures 120D, 120E, 120F:
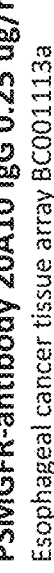

FIG. 120A-120F shows photographs of specific tissues from esophageal cancer tissue array BC001113 stained with the anti-PSMGFR antibody 20A10 at 0.25 ug/mL, magnified to 6× and 20×. FIG. 120A and FIG. 120D are photographs of the specimen at position A1. FIG. 120B and FIG. 120E are photographs of the specimen at position A7. FIG. 120C and FIG. 120F are photographs of the specimen at position A8.

Figures 121A, 121B, 121C:
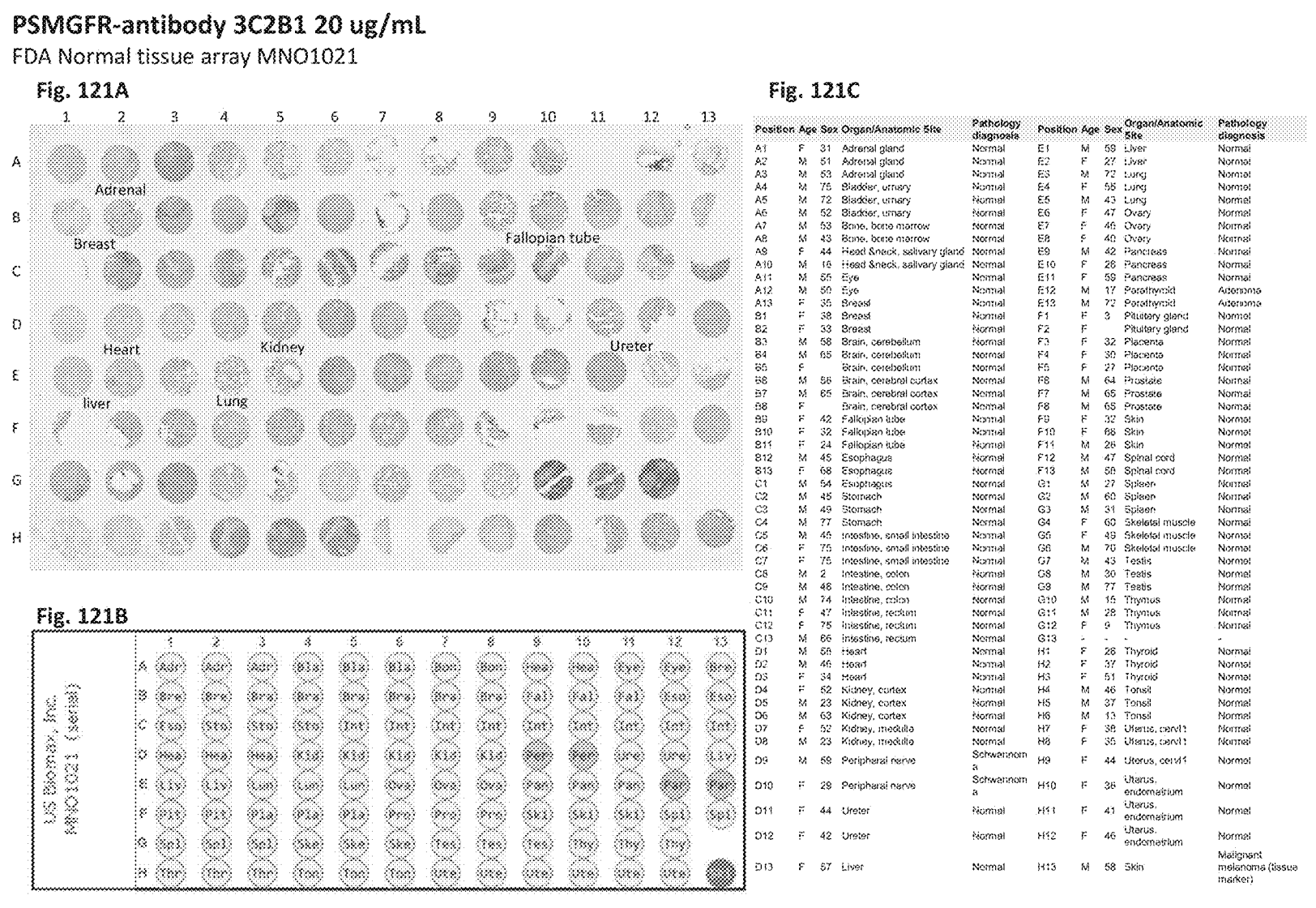

FIG. 121A-121C shows photographs, array map and description of FDA normal tissue array 1021 stained with the anti-PSMGFR antibody 3C2B1 at 20 ug/mL. FIG. 121A shows photographs of the tissue micro array. FIG. 121B shows map of the array with abbreviated tissue descriptors. FIG. 121C detailed description of the tissue micro array with non-identifying donor data.

Figures 122I, 122J, 122K, 122L, 122M, 122N, 122O, 122P:
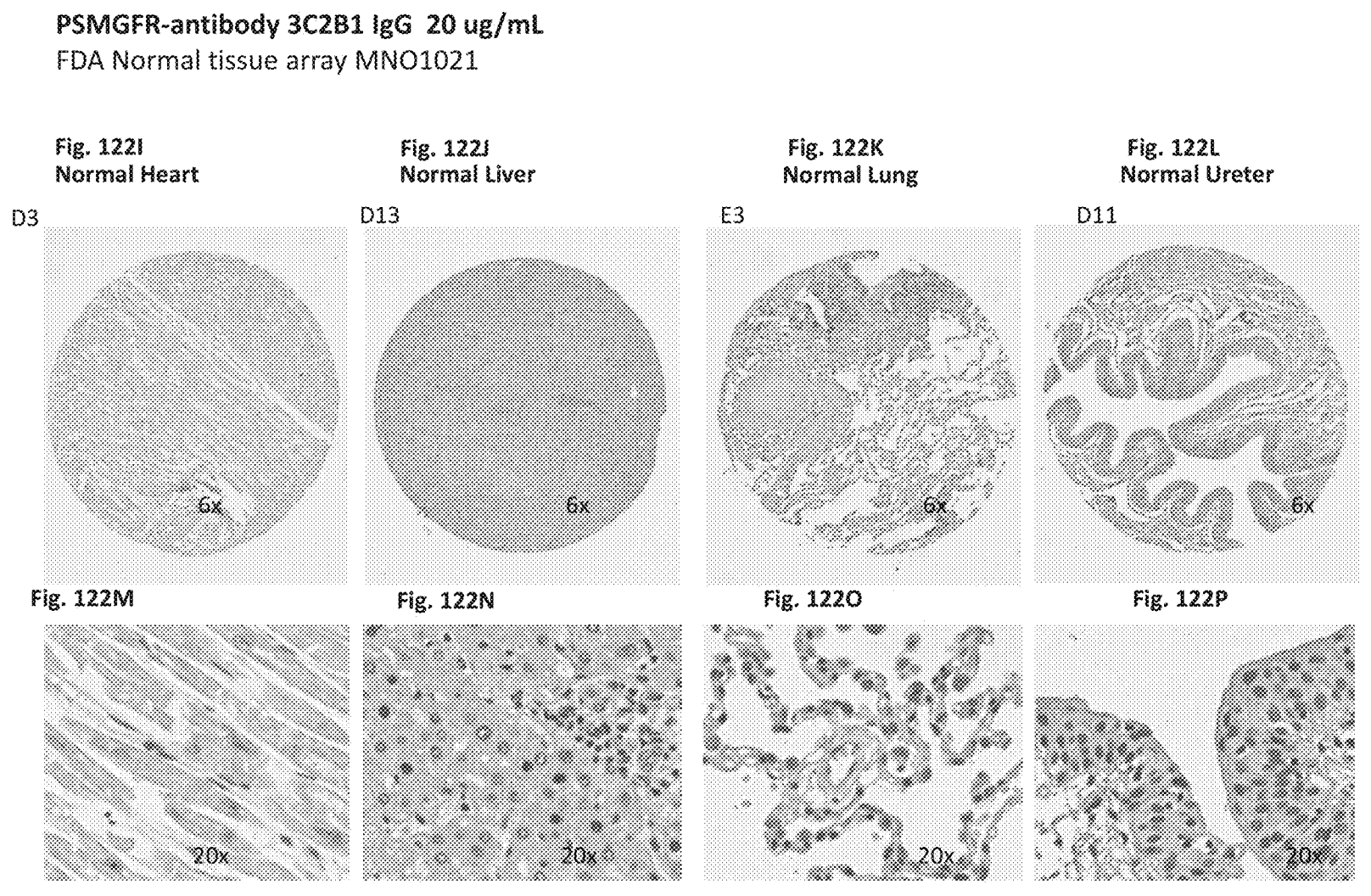
Figures 122Q, 122R, 122S, 122T, 122U, 122V, 122W, 122X:
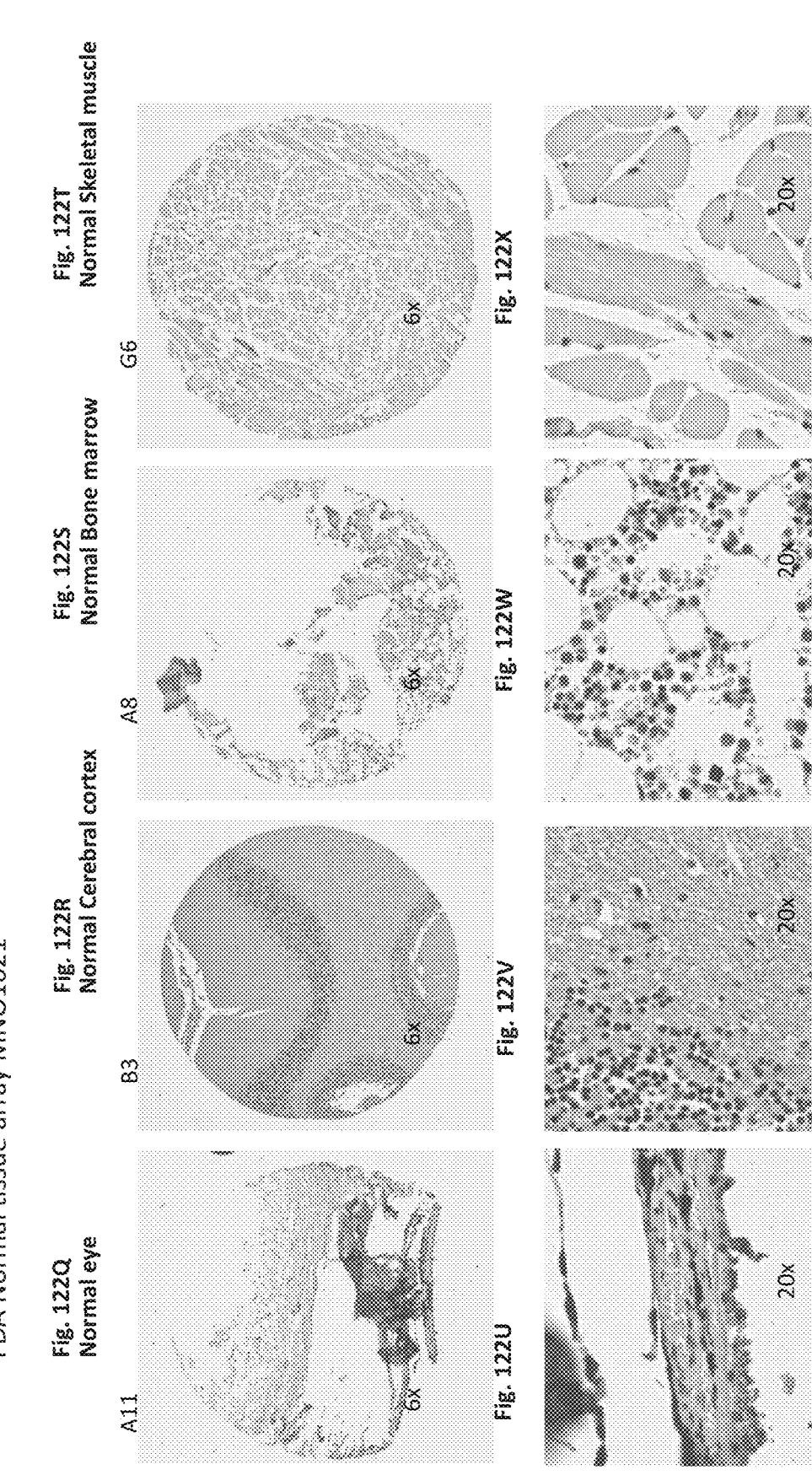

FIG. 122A-122X shows photographs of specific tissues from FDA normal tissue array 1021 stained with the anti-PSMGFR antibody 3C2B1 at 20 ug/mL, magnified to 6× and 20×. FIG. 122A and FIG. 122E are adrenal gland. FIG. 122B and FIG. 122F are breast. FIG. 122C and FIG. 122G are fallopian tube. FIG. 122D and FIG. 122H are kidney. FIG. 122I and FIG. 122M are heart muscle. FIG. 122J and FIG. 122N are liver. FIG. 122K and FIG. 122O are lung. FIG. 122L and FIG. 122P are ureter. FIG. 122Q and FIG. 122U are eye. FIG. 122R and FIG. 122V are cerebral cortex. FIG. 122S and FIG. 122W are bone marrow. FIG. 122T and FIG. 122X are skeletal muscle.

FIG. 123A-123C shows photographs, array map and description of pancreatic cancer tissue array PA1003 stained with the anti-PSMGFR antibody 3C2B1 at 20 ug/mL. FIG.

123A shows photographs of the tissue micro array. FIG. 123B shows map of the array with abbreviated tissue descriptors. FIG. 123C detailed description of the tissue micro array with non-identifying donor data.

Figures 124A, 124B, 124C, 124D, 124E, 124F:
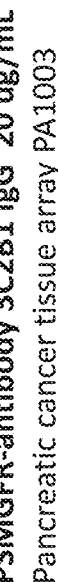

FIG. 124A-124F shows photographs of specific tissues from pancreatic cancer tissue array PA1003 stained with the anti-PSMGFR antibody 3C2B1 at 20 ug/mL, magnified to 6× and 20×. FIG. 124A and FIG. 124D are photographs of a Grade 2 adenocarcinoma. FIG. 124B and FIG. 124E are photographs of a Grade 2 adenocarcinoma. FIG. 124C and FIG. 124F are photographs of a Grade 2 adenocarcinoma.

Figures 125A, 125B, 125C:
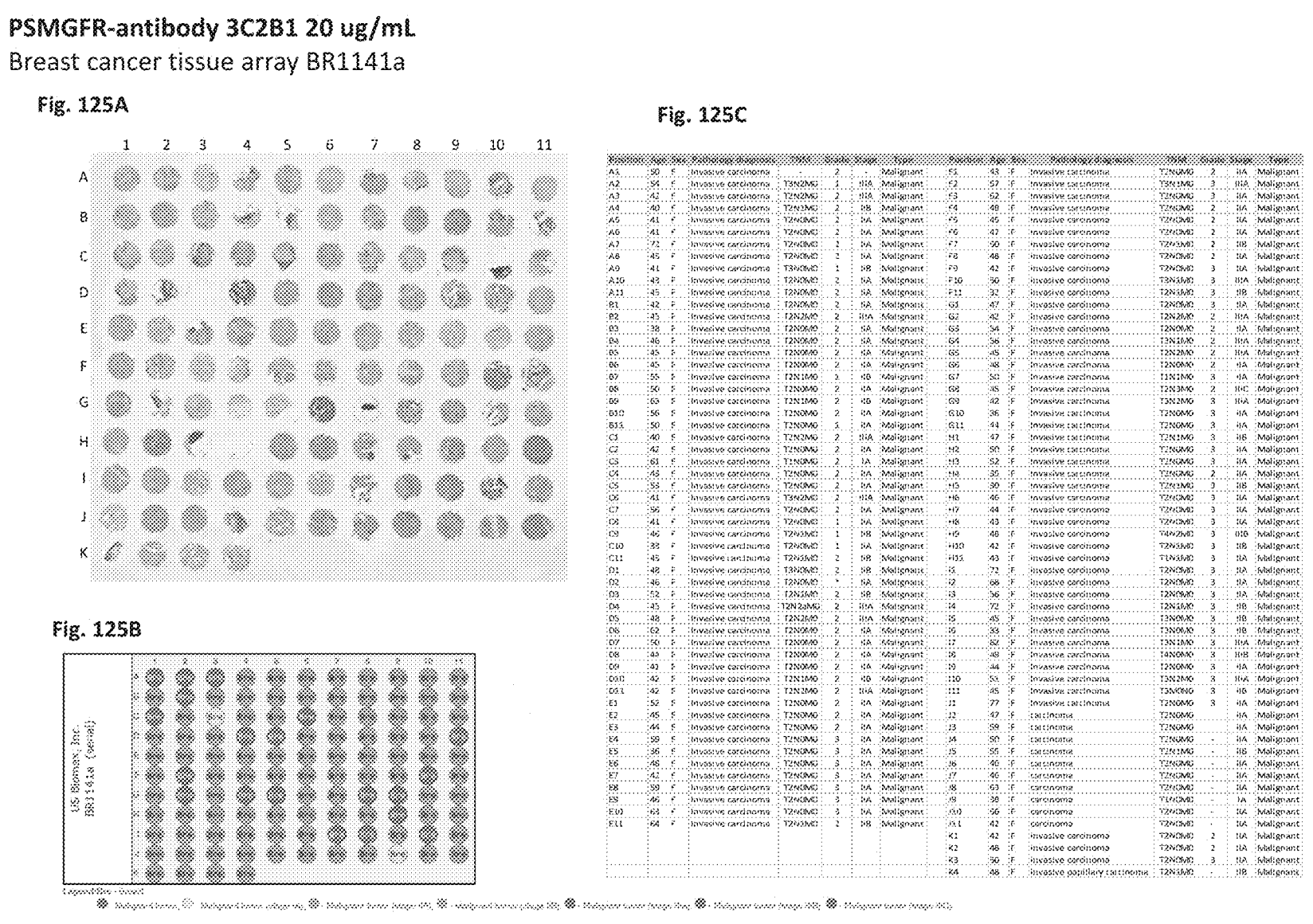

FIG. 125A-125C shows photographs, array map and description of breast cancer tissue array 1141 stained with the anti-PSMGFR antibody 3C2B1 at 20 ug/mL. FIG. 125A shows photographs of the tissue micro array. FIG. 125B shows map of the array with abbreviated tissue descriptors. FIG. 125C detailed description of the tissue micro array with non-identifying donor data.

Figures 126A, 126B, 126C, 126D, 126E, 126F:
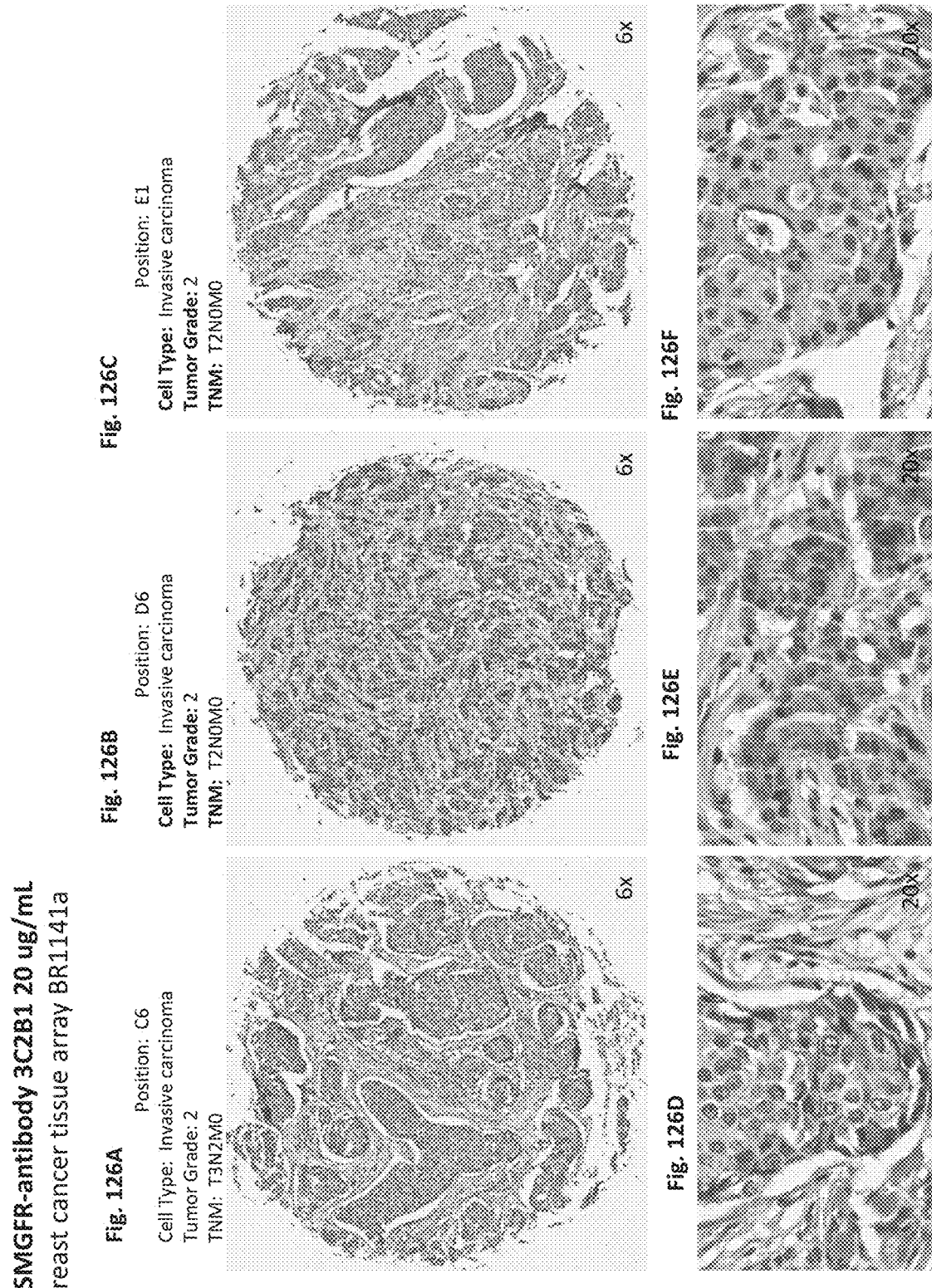

FIG. 126A-126F shows photographs of specific tissues from breast cancer tissue array 1141 stained with the anti-PSMGFR antibody 3C2B1 at 20 ug/mL, magnified to 6× and 20×. FIG. 126A and FIG. 126D are photographs of a Grade 2 invasive ductal carcinoma. FIG. 126B and FIG. 126E are photographs of a Grade 2 invasive ductal carcinoma. FIG. 126C and FIG. 126F are photographs of a Grade 2 invasive carcinoma.

FIG. 127A-127C shows photographs, array map and description of FDA normal tissue array 1021 stained with the anti-PSMGFR antibody 5C6F3 at 1 ug/mL. FIG. 127A shows photographs of the tissue micro array. FIG. 127B shows map of the array with abbreviated tissue descriptors. FIG. 127C detailed description of the tissue micro array with non-identifying donor data.

Figures 128I, 128J, 128K, 128L, 128M, 128N, 128O, 128P:
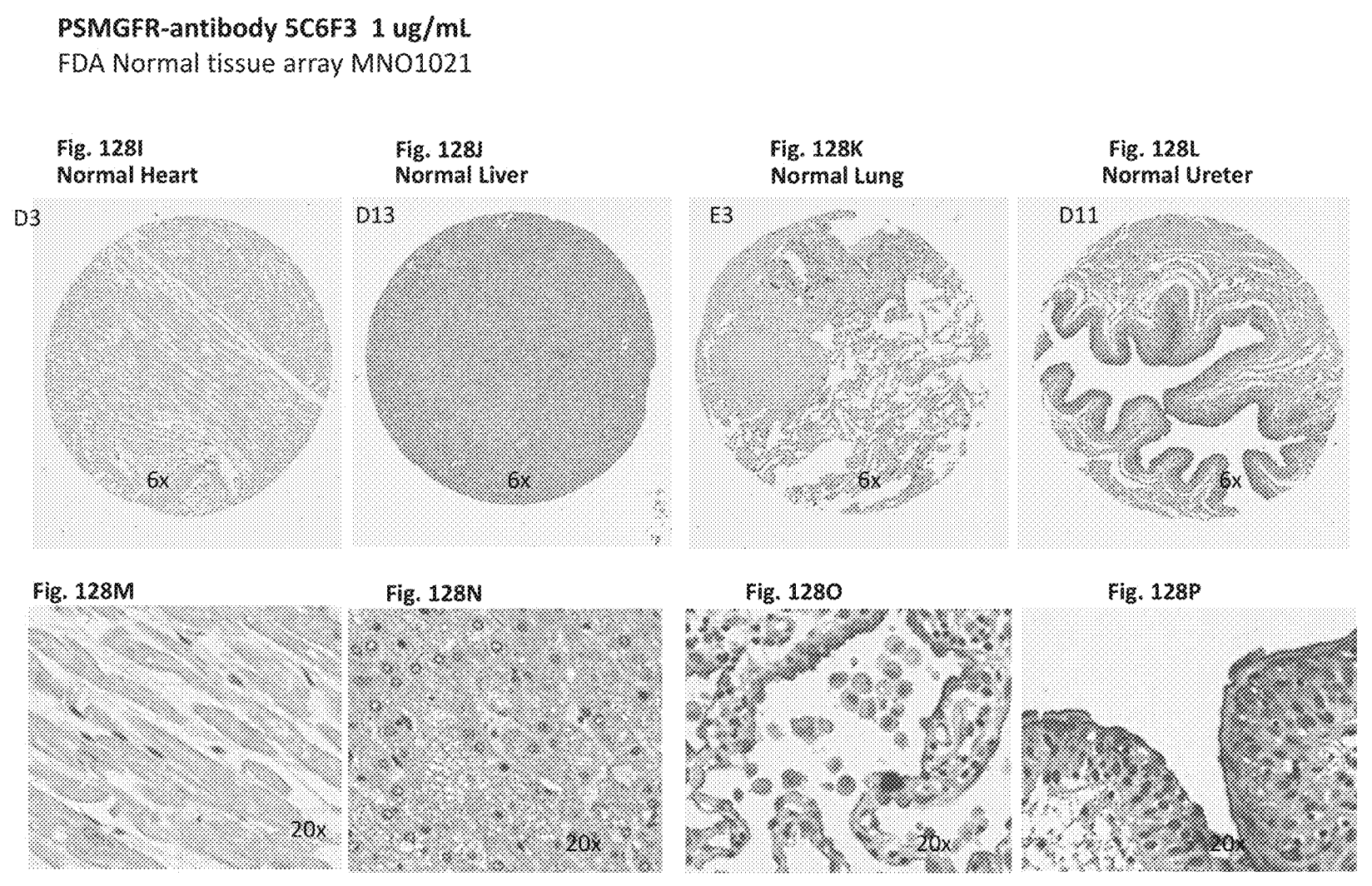

FIG. 128A-128X shows photographs of specific tissues from FDA normal tissue array 1021 stained with the anti-PSMGFR antibody 5C6F3 at 1 ug/mL, magnified to 6× and 20×. FIG. 128A and FIG. 128E are adrenal gland. FIG. 128B and FIG. 128F are breast. FIG. 128C and FIG. 128G are fallopian tube. FIG. 128D and FIG. 128H are kidney. FIG. 128I and FIG. 128M are heart muscle. FIG. 128J and FIG. 128N are liver. FIG. 128K and FIG. 128O are lung. FIG. 128L and FIG. 128P are ureter. FIG. 128Q and FIG. 128U are eye. FIG. 128R and FIG. 128V are cerebral cortex. FIG. 128S and FIG. 128W are bone marrow. FIG. 128T and FIG. 128X are skeletal muscle.

Figures 129A, 129B, 129C:
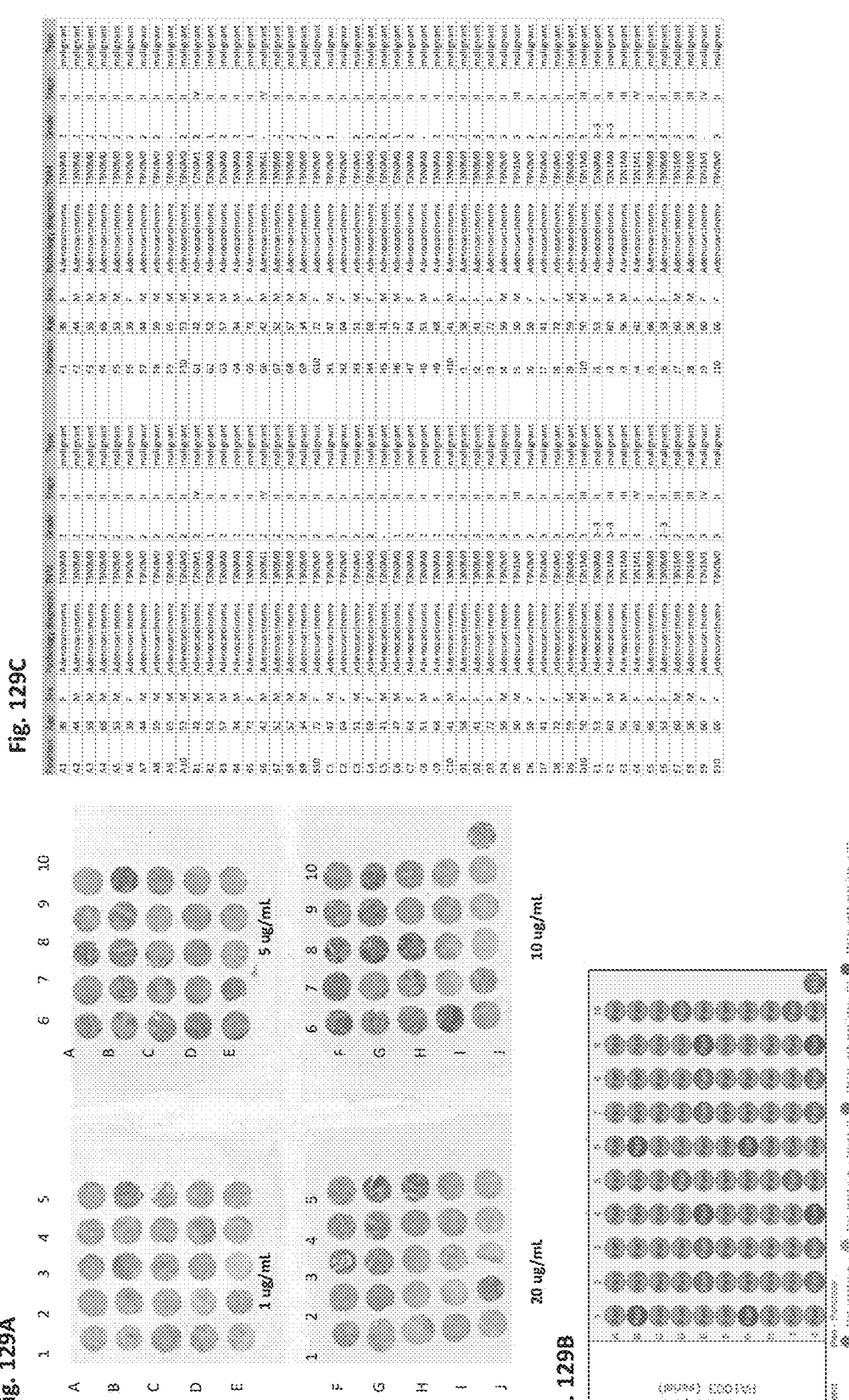

FIG. 129A-129C shows photographs, array map and description of pancreatic cancer tissue array PA1003 stained with the anti-PSMGFR antibody 5C6F3 at 1-20 ug/mL. FIG. 129A shows photographs of the tissue micro array. FIG. 129B shows map of the array with abbreviated tissue descriptors. FIG. 129C detailed description of the tissue micro array with non-identifying donor data.

Figures 130A, 130B, 130C, 130D, 130E, 130F:
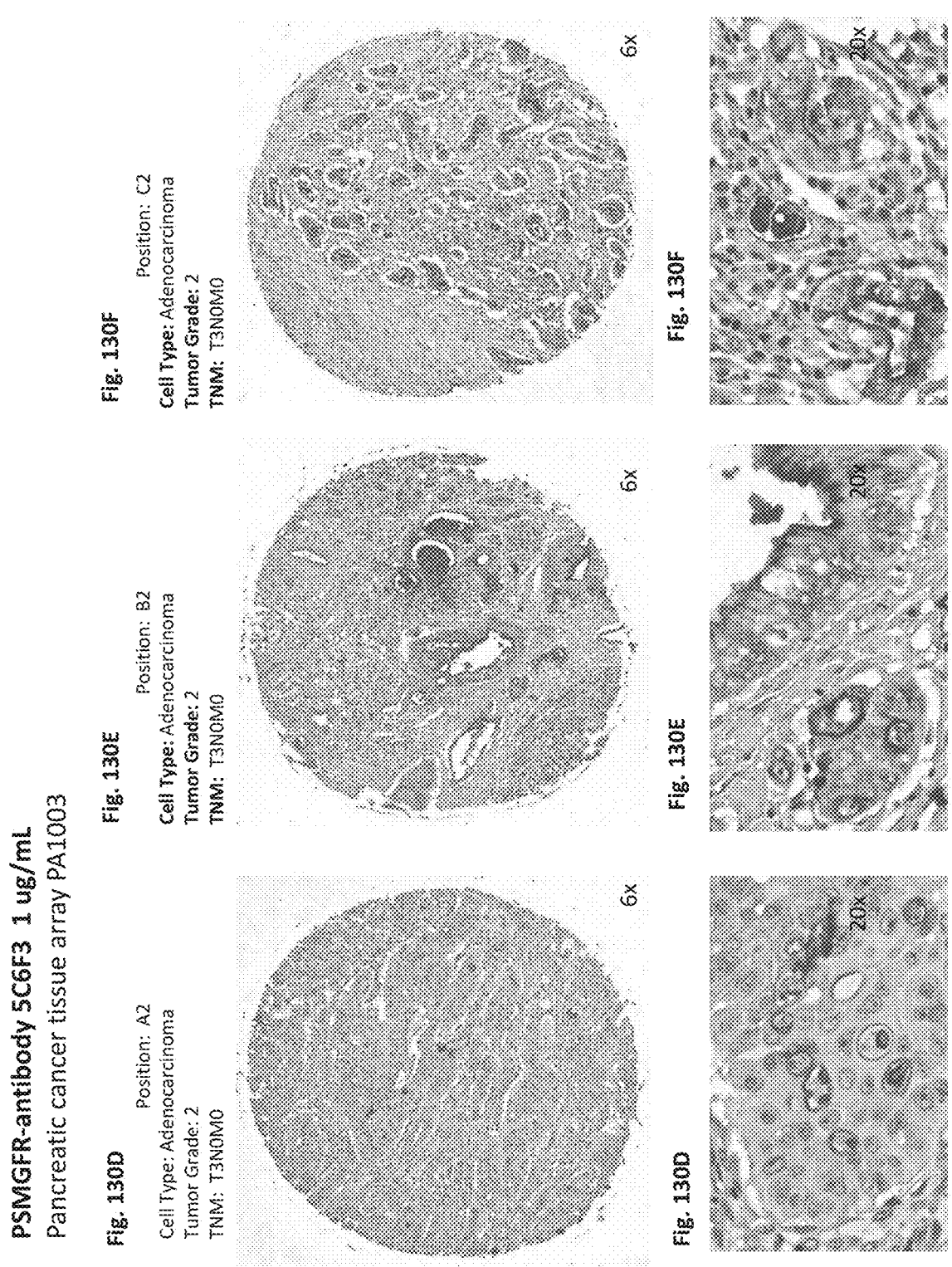

FIG. 130A-130F shows photographs of specific tissues from pancreatic cancer tissue array PA1003 stained with the anti-PSMGFR antibody 5C6F3 at 1 ug/mL, magnified to 6× and 20×. FIG. 130A and FIG. 130D are photographs of a Grade 2 adenocarcinoma. FIG. 130B and FIG. 130E are photographs of a Grade 2 adenocarcinoma. FIG. 130C and FIG. 130F are photographs of a Grade 2 adenocarcinoma.

Figures 131A, 131B, 131C:
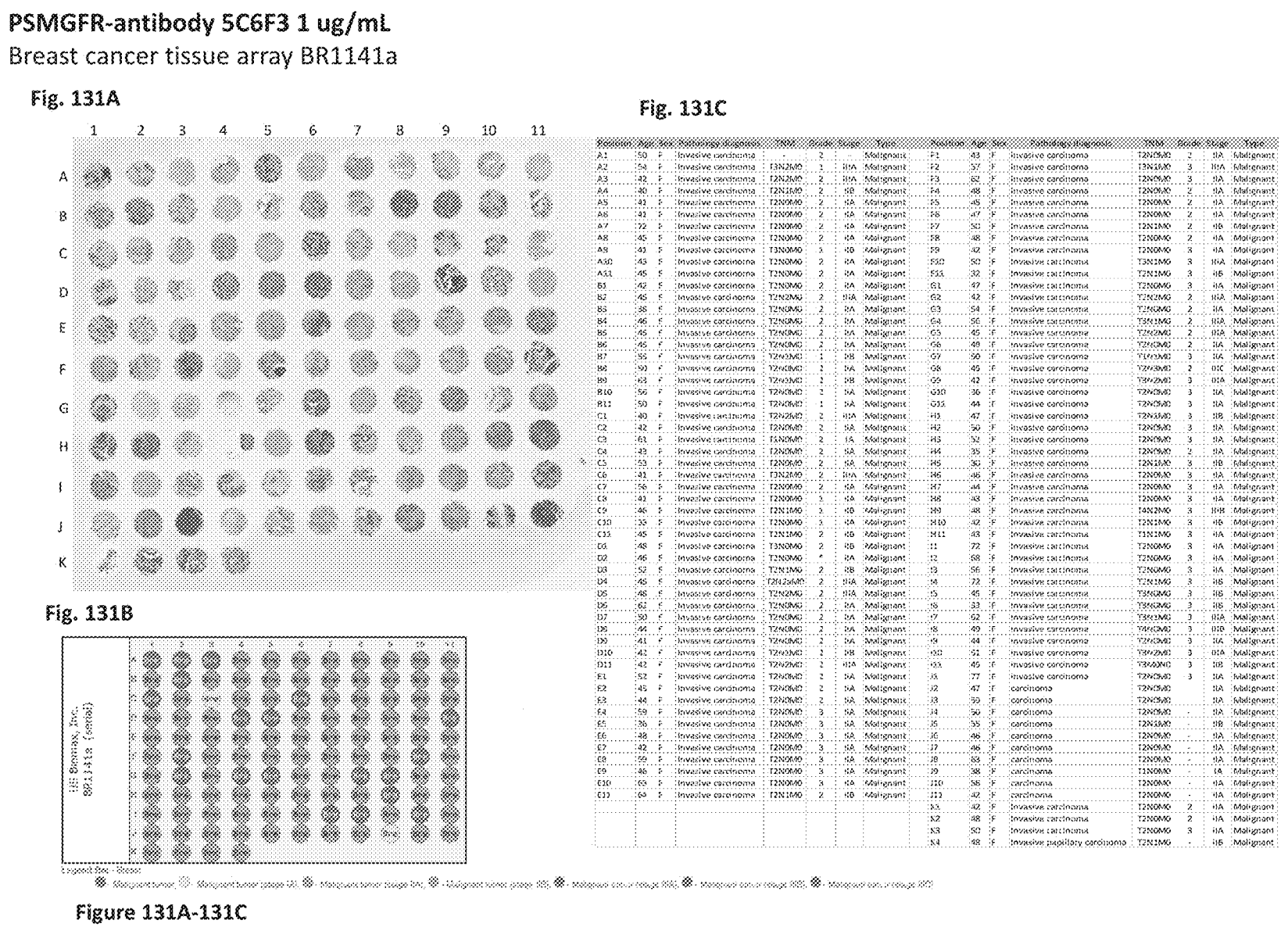

FIG. 131A-131C shows photographs, array map and description of breast cancer tissue array 1141 stained with the anti-PSMGFR antibody 5C6F3 at 1 ug/mL. FIG. 131A shows photographs of the tissue micro array. FIG. 131B shows map of the array with abbreviated tissue descriptors. FIG. 131C detailed description of the tissue micro array with non-identifying donor data.

Figures 132A, 132B, 132C, 132D, 132E, 132F:
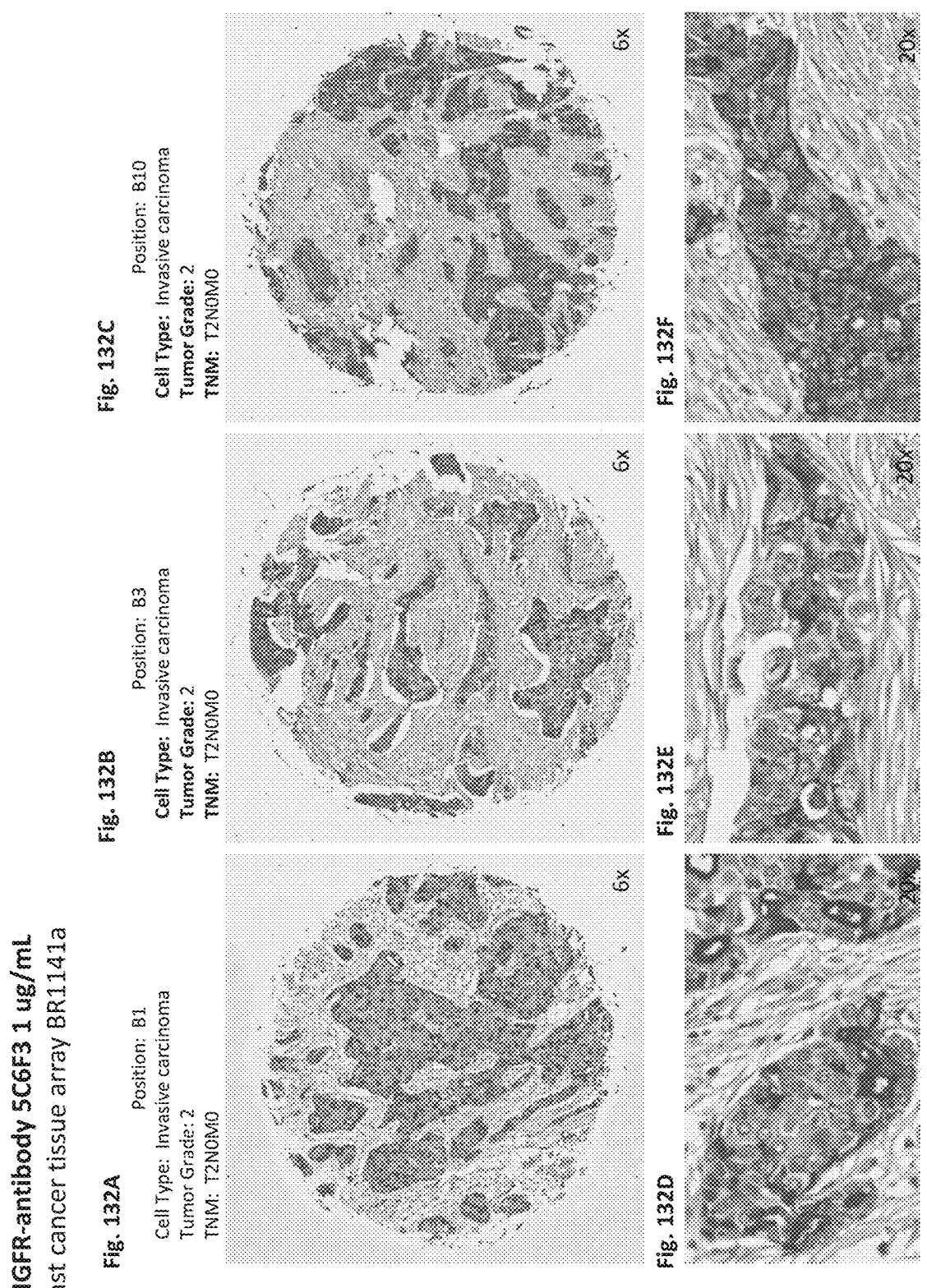

FIG. 132A-132F shows photographs of specific tissues from breast cancer tissue array 1141 stained with the anti-PSMGFR antibody 5C6F3 at 1 ug/mL, magnified to 6× and 20×. FIG. 132A and FIG. 132D are photographs of a Grade 2 invasive ductal carcinoma. FIG. 132B and FIG. 132E are photographs of a Grade 2 invasive ductal carcinoma. FIG. 132C and FIG. 132F are photographs of a Grade 2 invasive carcinoma.

FIG. 133A-133C shows photographs, array map and description of FDA normal tissue array 1021 stained with the anti-PSMGFR antibody 18B4 at 10 ug/mL. FIG. 133A shows photographs of the tissue micro array. FIG. 133B shows map of the array with abbreviated tissue descriptors. FIG. 133C detailed description of the tissue micro array with non-identifying donor data.

Figures 134I, 134J, 134K, 134L, 134M, 134N, 134O, 134P:
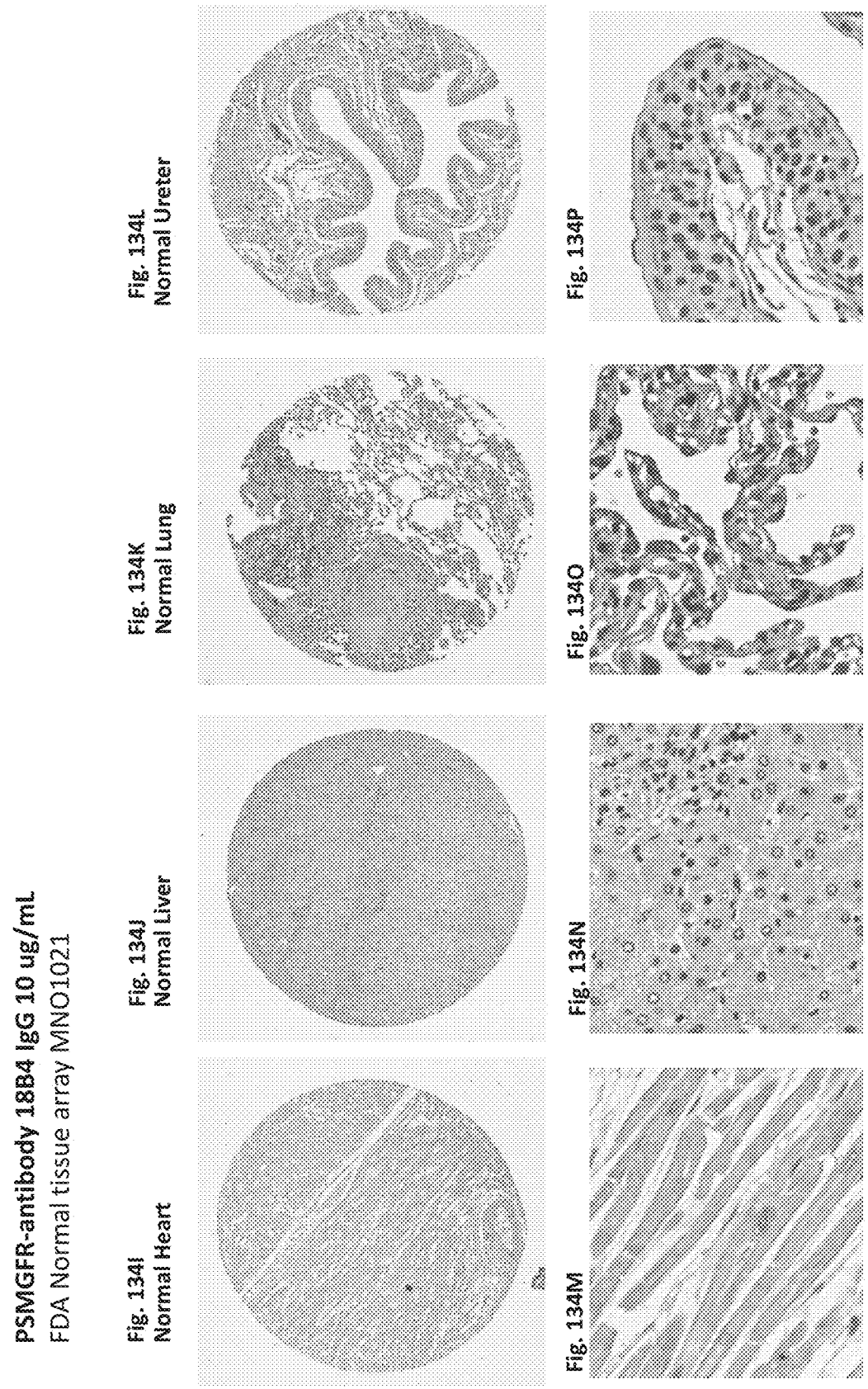
Figures 134Q, 134R, 134S, 134T, 134U, 134V, 134W, 134X:
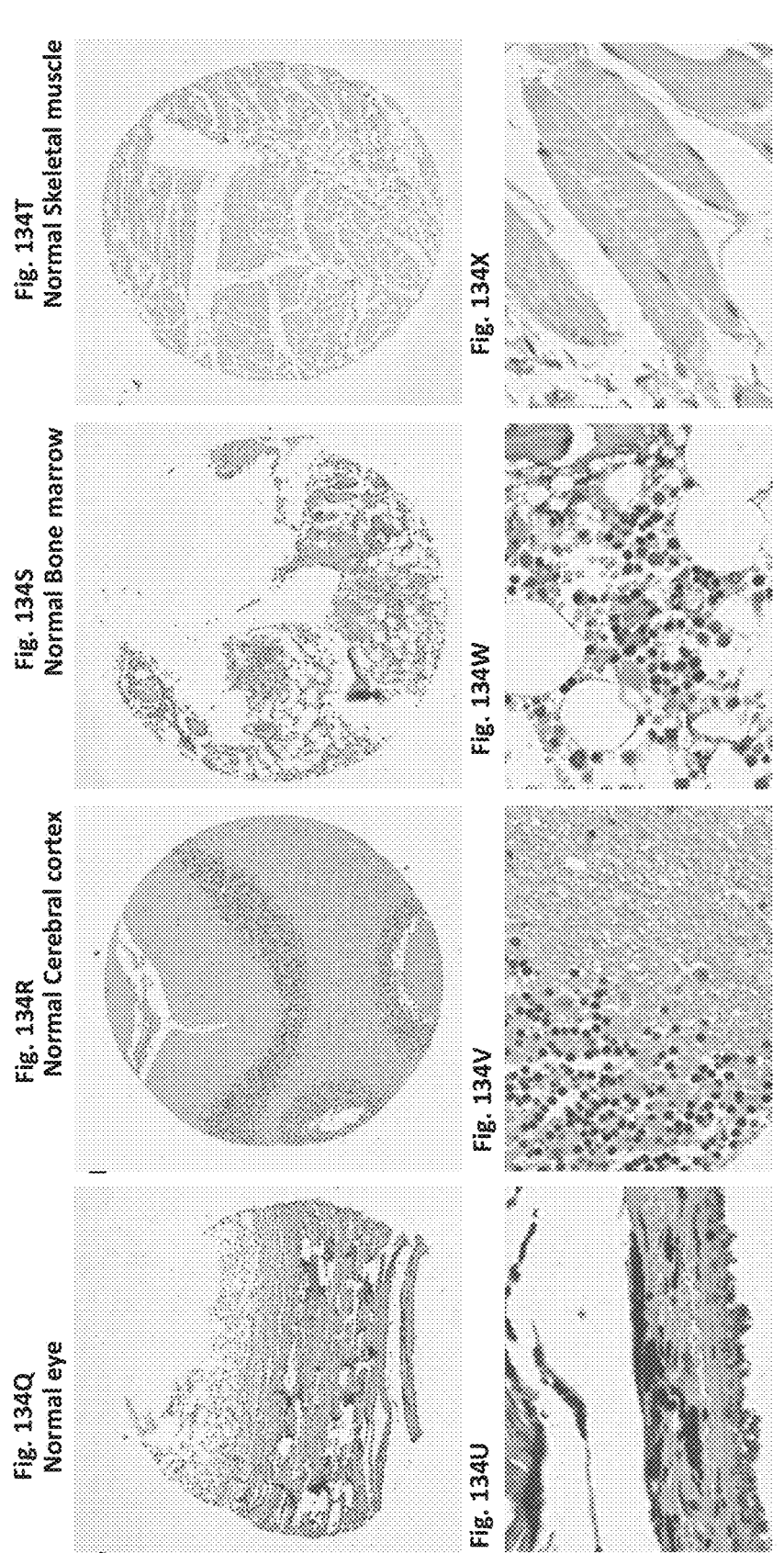

FIG. 134A-134X shows photographs of specific tissues from FDA normal tissue array 1021 stained with the anti-PSMGFR antibody 18B4 at 10 ug/mL, magnified to 6× and 20×. FIG. 134A and FIG. 134E are adrenal gland. FIG. 134B and FIG. 134F are breast. FIG. 134C and FIG. 134G are fallopian tube. FIG. 134D and FIG. 134H are kidney. FIG. 134I and FIG. 134M are heart muscle. FIG. 134J and FIG. 134N are liver. FIG. 134K and FIG. 134O are lung. FIG. 134L and FIG. 134P are ureter. FIG. 134Q and FIG. 134U are eye. FIG. 134R and FIG. 134V are cerebral cortex. FIG. 134S and FIG. 134W are bone marrow. FIG. 134T and FIG. 134X are skeletal muscle.

Figures 135A, 135B, 135C:
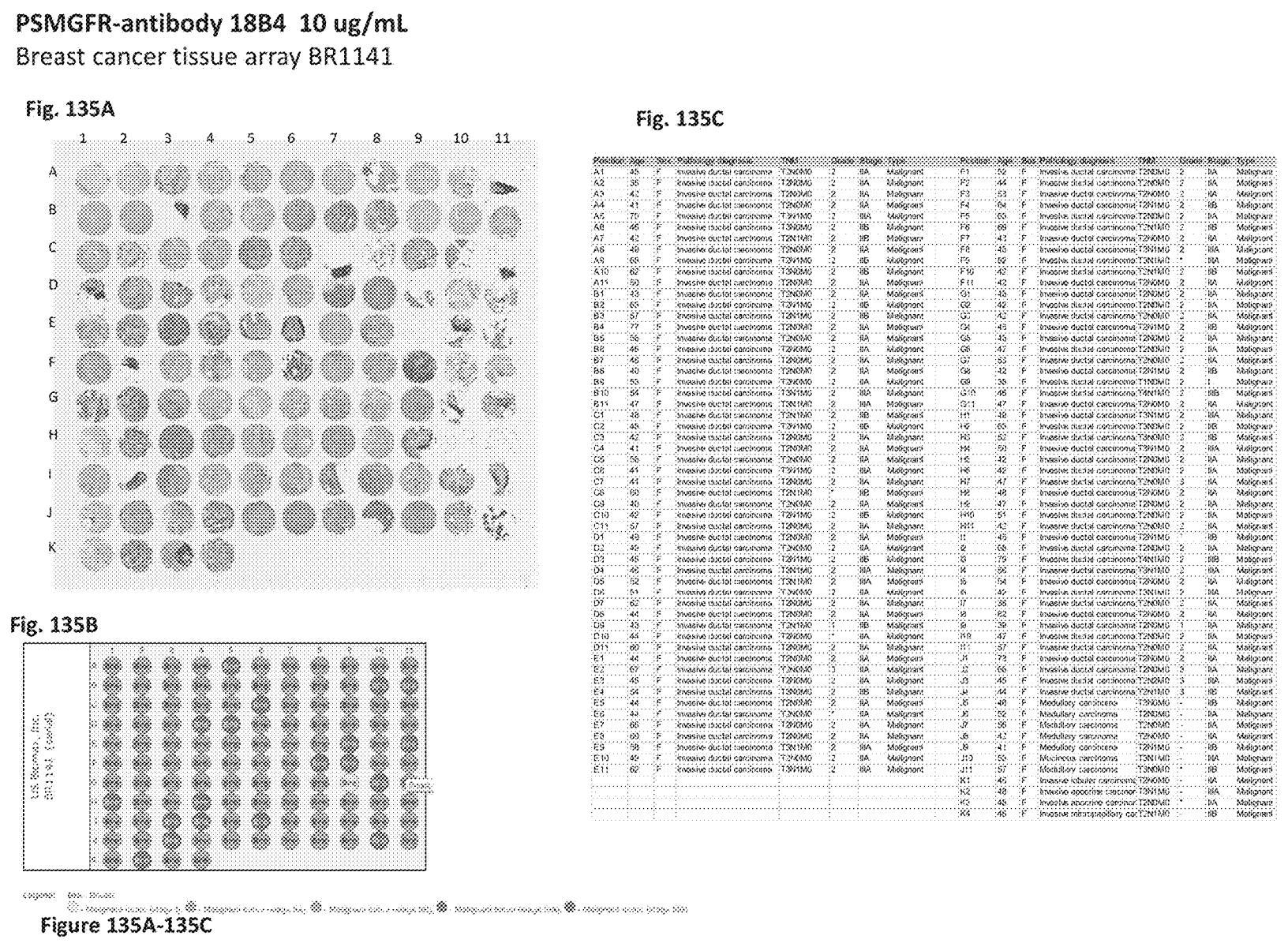

FIG. 135A-135C shows photographs, array map and description of breast cancer tissue array 1141 stained with the anti-PSMGFR antibody 18B4 at 10 ug/mL. FIG. 135A shows photographs of the tissue micro array. FIG. 135B shows map of the array with abbreviated tissue descriptors. FIG. 135C detailed description of the tissue micro array with non-identifying donor data.

Figures 136A, 136B, 136C, 136D, 136E, 136F:
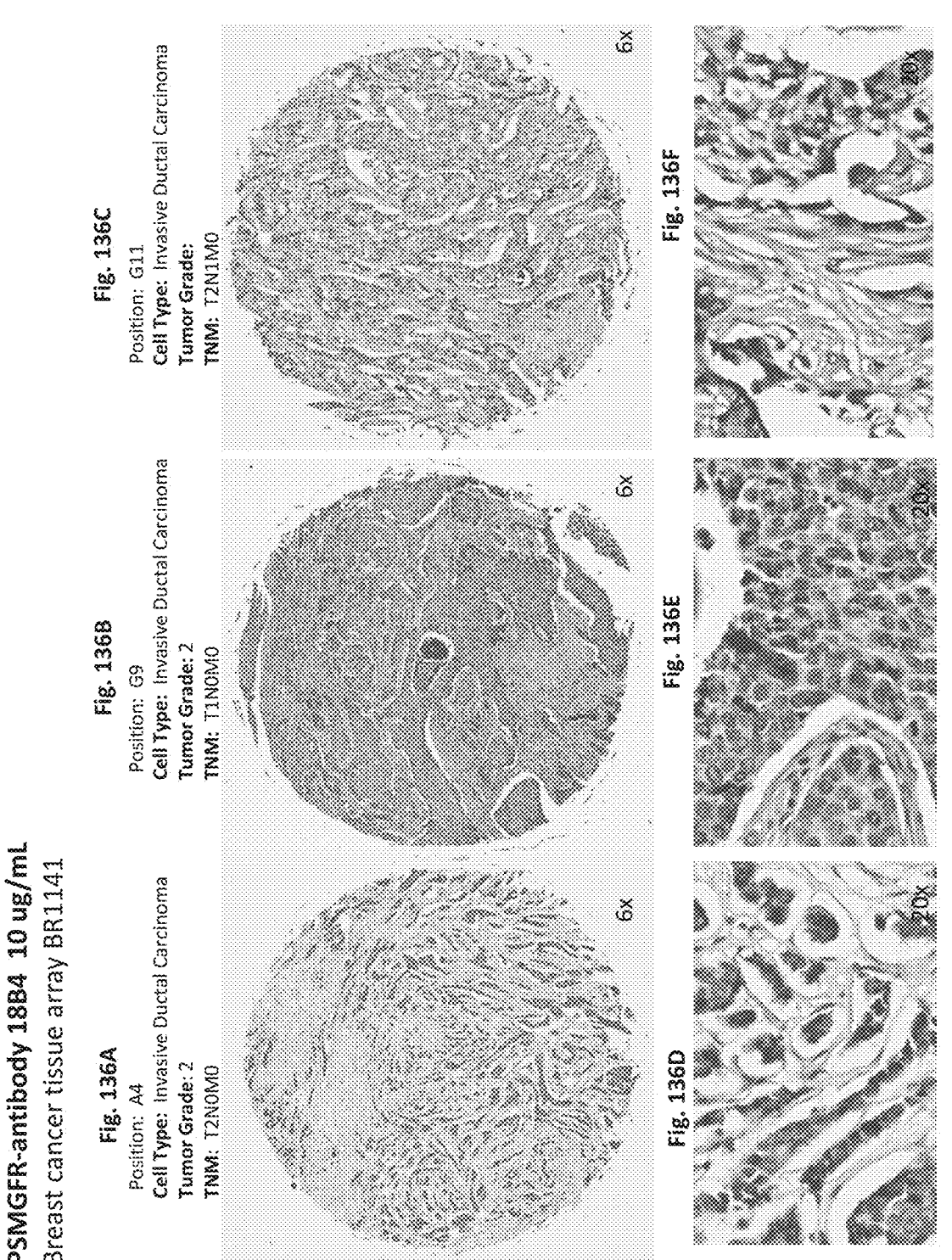

FIG. 136A-136F shows photographs of specific tissues from breast cancer tissue array 1141 stained with the anti-PSMGFR antibody 18B4 at 10 ug/mL, magnified to 6× and 20×. FIG. 136A and FIG. 136D are photographs of a Grade 2 invasive ductal carcinoma. FIG. 136B and FIG. 136E are photographs of a Grade 2 invasive ductal carcinoma. FIG. 136C and FIG. 136F are photographs of a Grade 2 invasive ductal carcinoma.

Figures 137A, 137B, 137C:
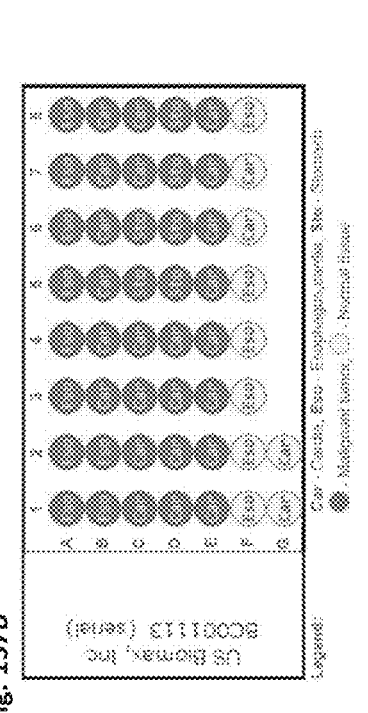

FIG. 137A-137C shows photographs, array map and description of esophageal cancer tissue array BC001113 stained with the anti-PSMGFR antibody 18B4 at 10 ug/mL. FIG. 137A shows photographs of the tissue micro array. FIG. 137B shows map of the array with abbreviated tissue descriptors. FIG. 137C detailed description of the tissue micro array with non-identifying donor data.

FIG. 138A-138F shows photographs of specific tissues from esophageal cancer tissue array BC001113 stained with the anti-PSMGFR antibody 18B4 at 10 ug/mL, magnified to 6× and 20×. FIG. 138A and FIG. 138D are photographs of the specimen at position A1. FIG. 138B and FIG. 138E are photographs of the specimen at position A7. FIG. 138C and FIG. 138F are photographs of the specimen at position A8.

Figures 139A, 139B, 139C:
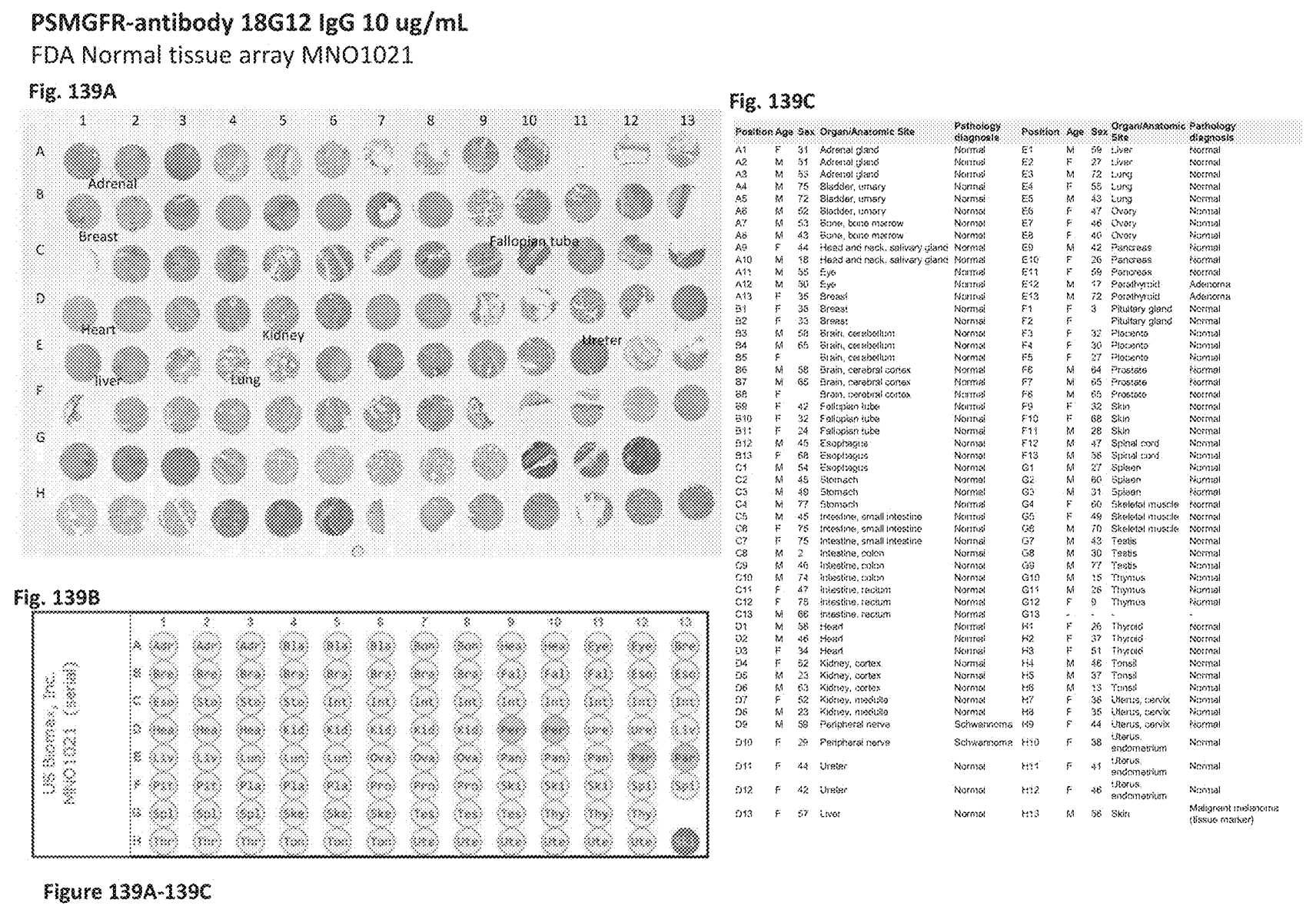

FIG. 139A-139C shows photographs, array map and description of FDA normal tissue array 1021 stained with the anti-PSMGFR antibody 18G12 at 10 ug/mL. FIG. 139A shows photographs of the tissue micro array. FIG. 139B shows map of the array with abbreviated tissue descriptors. FIG. 139C detailed description of the tissue micro array with non-identifying donor data.

Figures 140A, 140B, 140C, 140D, 140E, 140F, 140G, 140H:
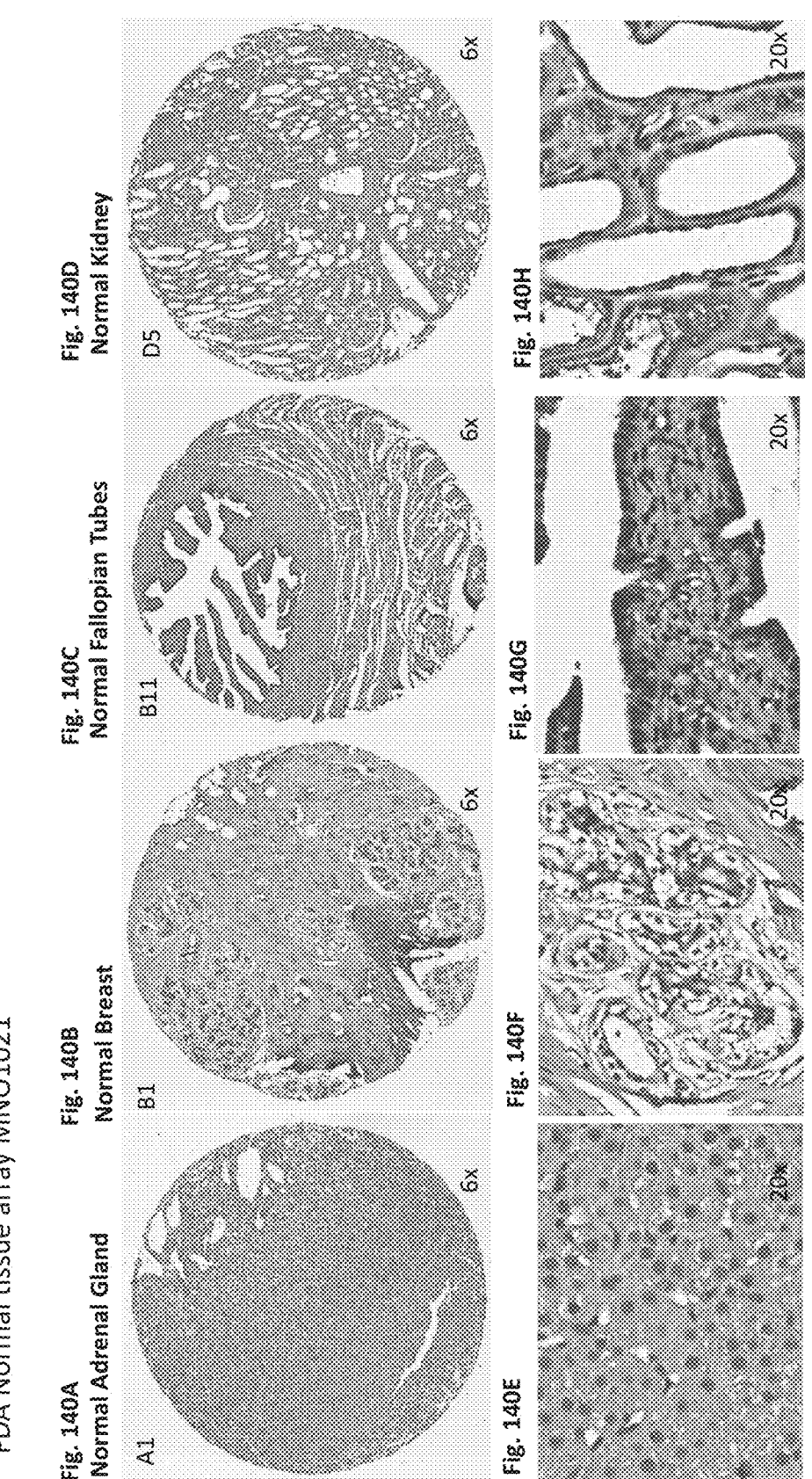
Figures 140Q, 140R, 140S, 140T, 140U, 140V, 140W, 140X:
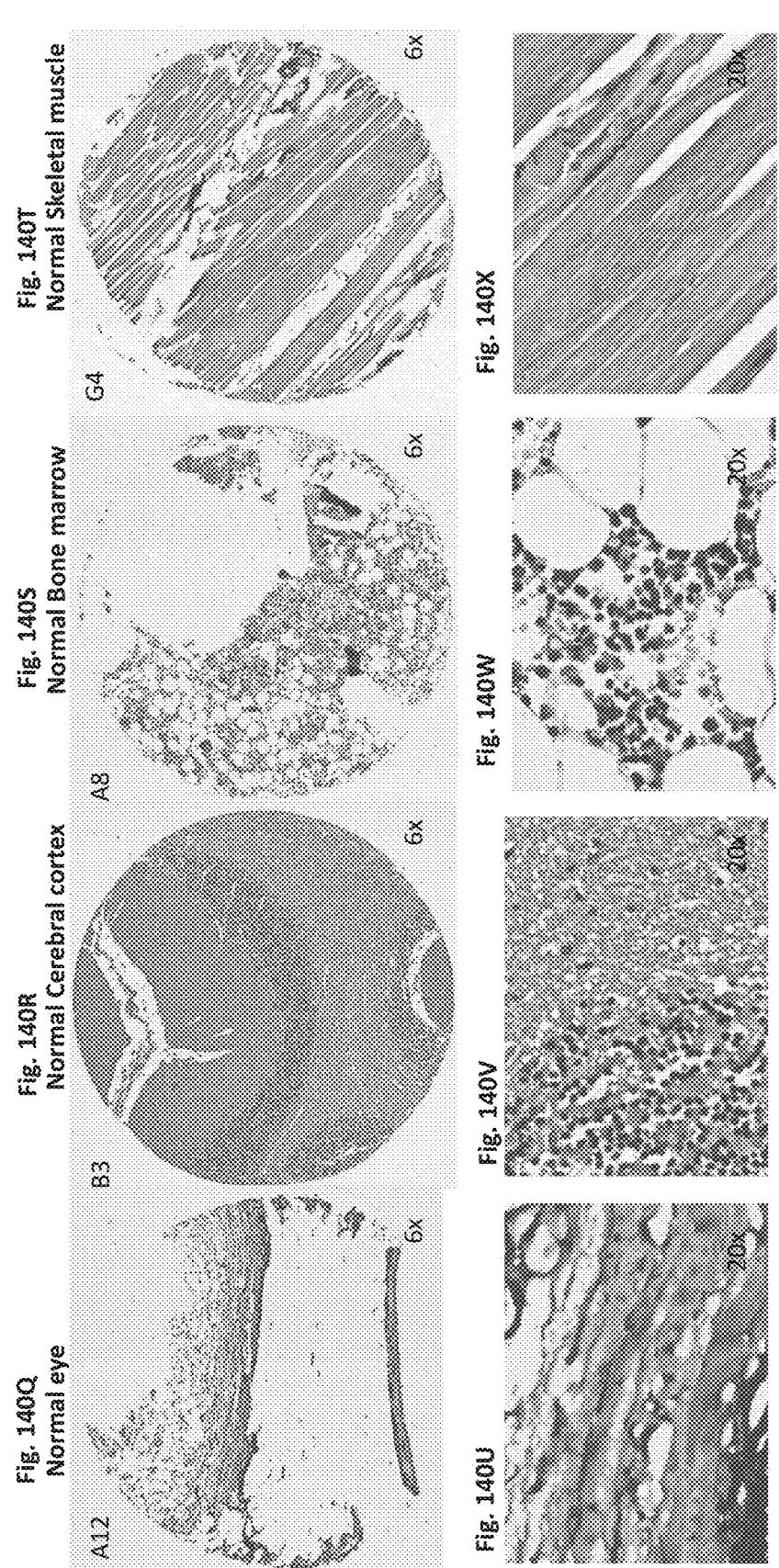

FIG. 140A-140X shows photographs of specific tissues from FDA normal tissue array 1021 stained with the anti-PSMGFR antibody 18G12 at 10 ug/mL, magnified to 6× and 20×. FIG. 140A and FIG. 140E are adrenal gland. FIG. 140B and FIG. 140F are breast. FIG. 140C and FIG. 140G are fallopian tube. FIG. 140D and FIG. 140H are kidney. FIG. 140I and FIG. 140M are heart muscle. FIG. 140J and FIG. 140N are liver. FIG. 140K and FIG. 140O are lung. FIG. 140L and FIG. 140P are ureter. FIG. 140Q and FIG. 140U are eye. FIG. 140R and FIG. 140V are cerebral cortex. FIG. 140S and FIG. 140W are bone marrow. FIG. 140T and FIG. 140X are skeletal muscle.

Figures 141A, 141B, 141C:
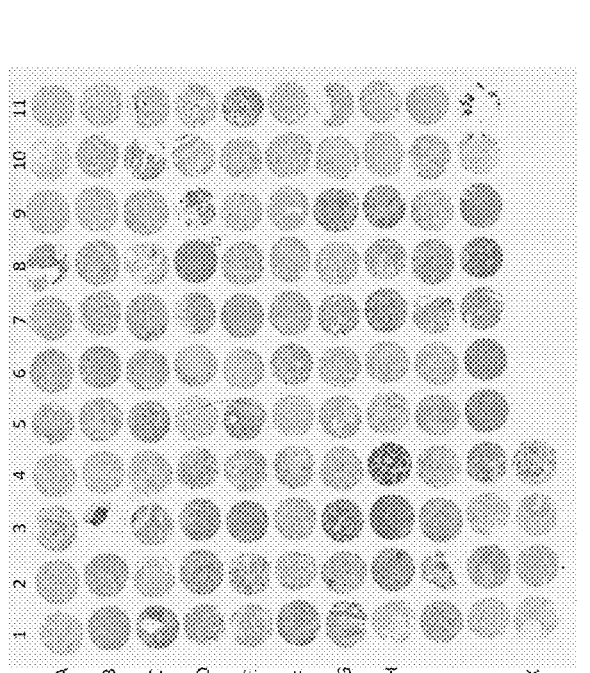

FIG. 141A-141C shows photographs, array map and description of breast cancer tissue array 1141 stained with the anti-PSMGFR antibody 18G12 at 15 ug/mL. FIG. 141A shows photographs of the tissue micro array. FIG. 141B shows map of the array with abbreviated tissue descriptors. FIG. 141C detailed description of the tissue micro array with non-identifying donor data.

Figures 142A, 142B, 142C, 142D, 142E, 142F:
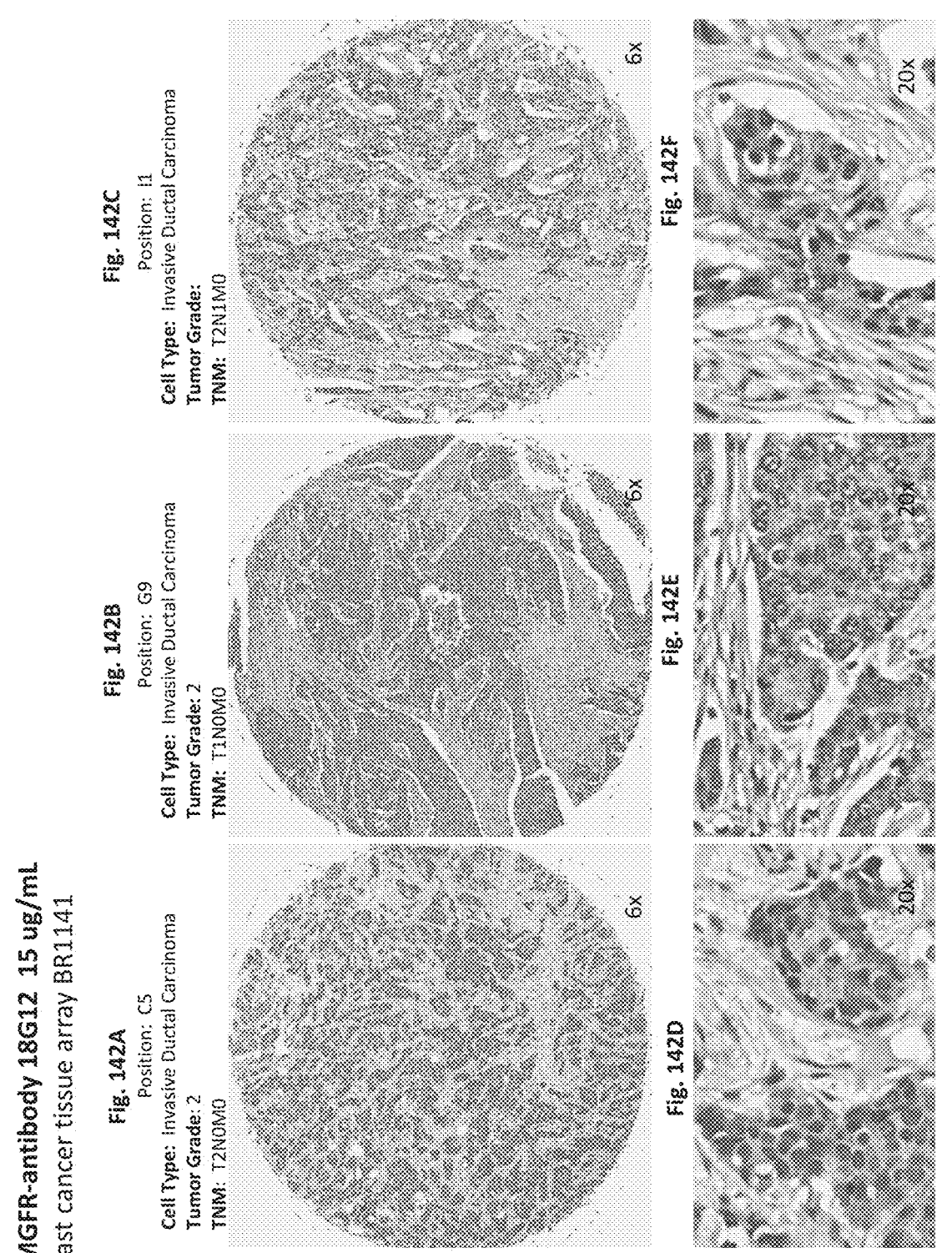

FIG. 142A-142F shows photographs of specific tissues from breast cancer tissue array 1141 stained with the anti-PSMGFR antibody 18G12 at 15 ug/mL, magnified to 6× and 20×. FIG. 142A and FIG. 142D are photographs of a Grade 2 invasive ductal carcinoma. FIG. 142B and FIG. 142E are photographs of a Grade 2 invasive ductal carcinoma. FIG. 142C and FIG. 142F are photographs of a Grade 2 invasive ductal carcinoma.

Figures 143A, 143B, 143C:
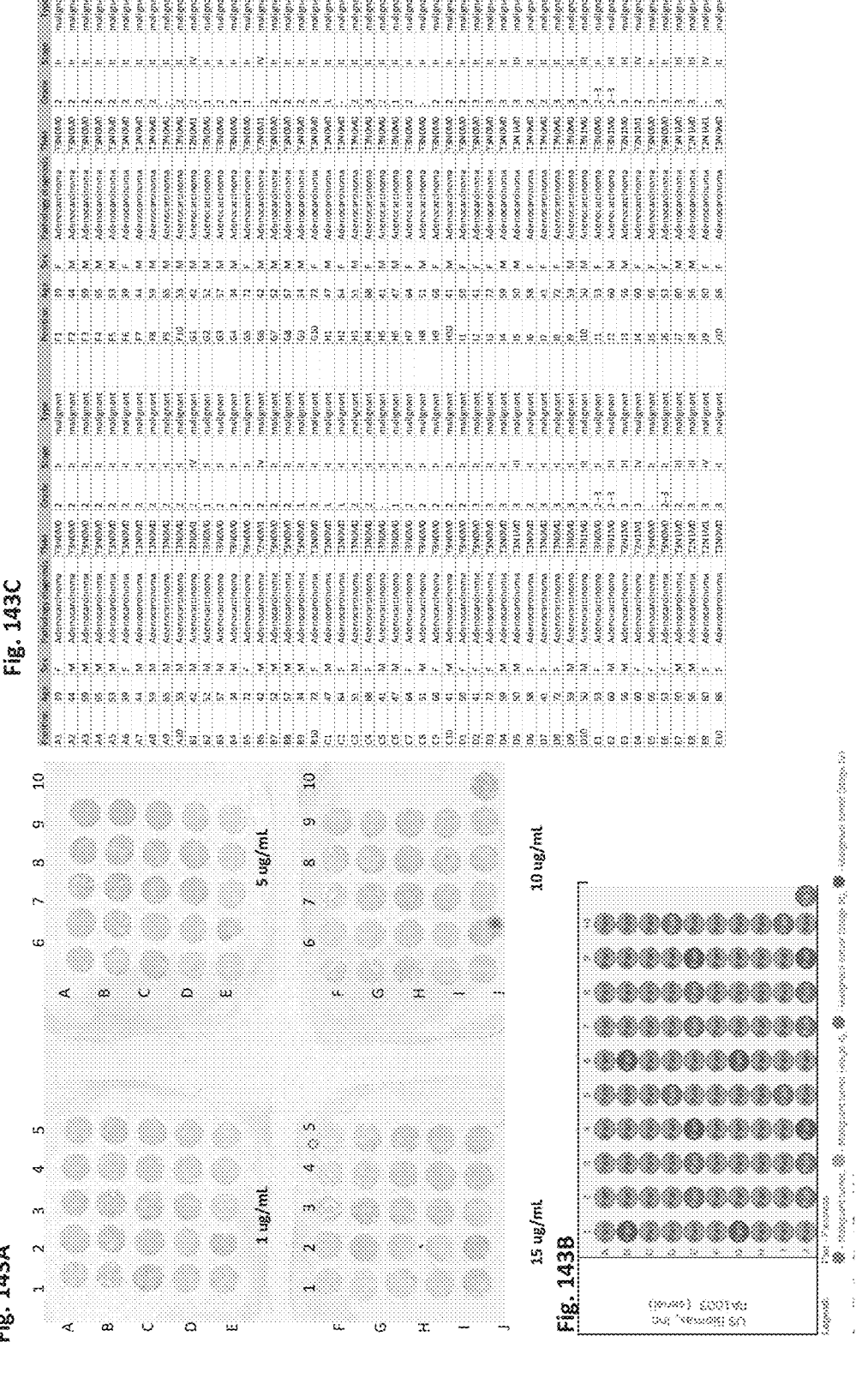

FIG. 143A-143C shows photographs, array map and description of pancreatic cancer tissue array PA1003 stained with the anti-PSMGFR antibody 18G12 at 15 ug/mL. FIG. 143A shows photographs of the tissue micro array. FIG. 143B shows map of the array with abbreviated tissue descriptors. FIG. 143C detailed description of the tissue micro array with non-identifying donor data.

Figures 144A, 144B, 144C, 144D, 144E, 144F:
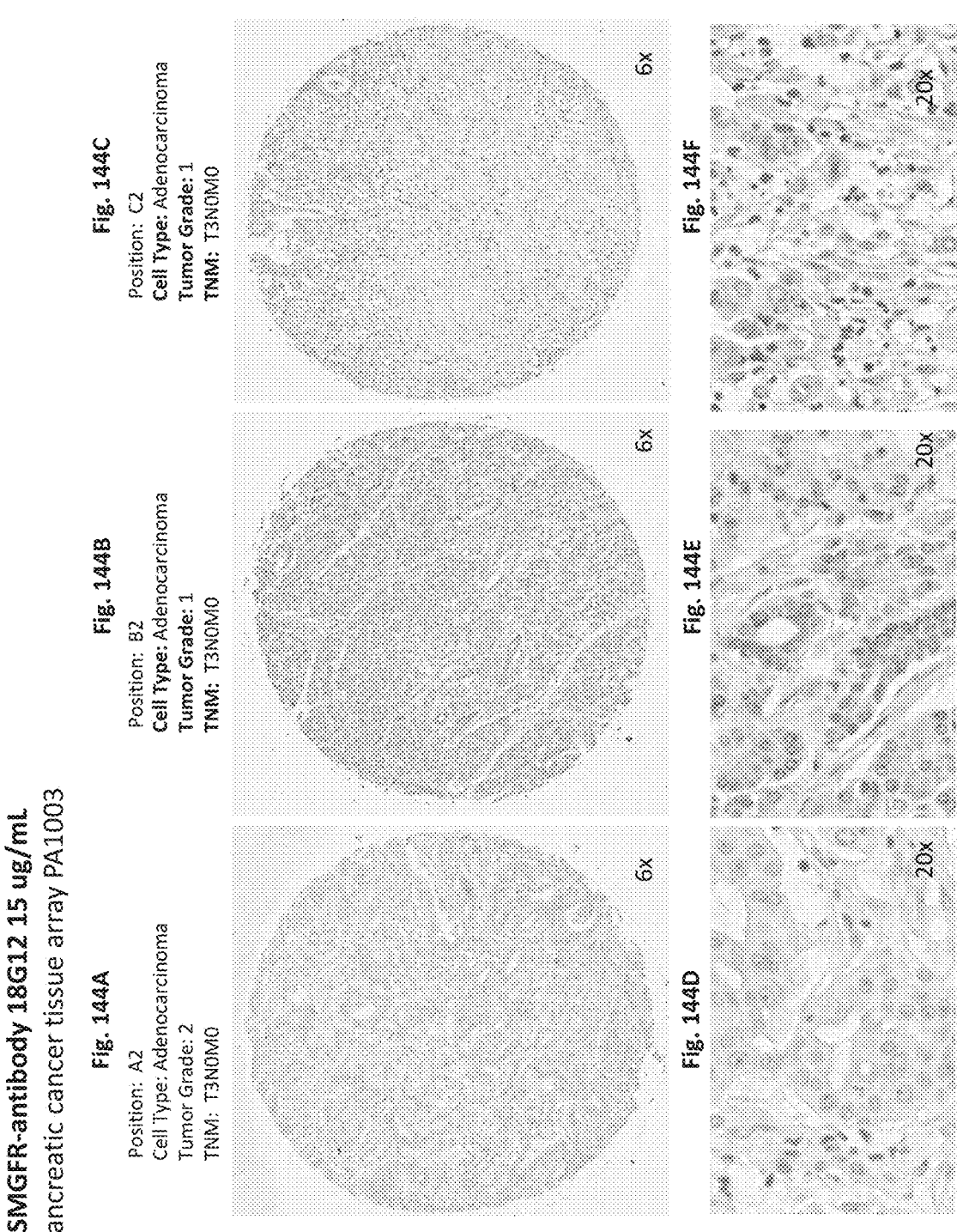

FIG. 144A-144F shows photographs of specific tissues from pancreatic cancer tissue array PA1003 stained with the anti-PSMGFR antibody 18G12 at 15 ug/mL, magnified to 6× and 20×. FIG. 144A and FIG. 144D are photographs of a Grade 2 adenocarcinoma. FIG. 144B and FIG. 144E are photographs of a Grade 2 adenocarcinoma. FIG. 144C and FIG. 144F are photographs of a Grade 2-3 adenocarcinoma with lymph node involvement.

Figures 145A, 145B, 145C:
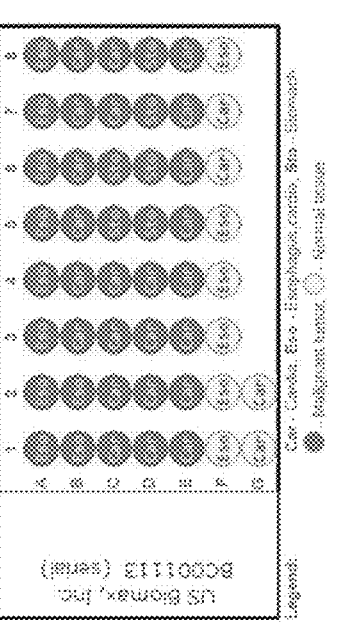

FIG. 145A-145C shows photographs, array map and description of esophageal cancer tissue array BC001113 stained with the anti-PSMGFR antibody 18G12 at 30 ug/mL. FIG. 145A shows photographs of the tissue micro array. FIG. 145B shows map of the array with abbreviated tissue descriptors. FIG. 145C detailed description of the tissue micro array with non-identifying donor data.

FIG. 146A-146F shows photographs of specific tissues from esophageal cancer tissue array BC001113 stained with the anti-PSMGFR antibody 18G12 at 30 ug/mL, magnified to 6× and 20×. FIG. 146A and FIG. 146D are photographs of the specimen at position A1. FIG. 146B and FIG. 146E are photographs of the specimen at position A7. FIG. 146C and FIG. 146F are photographs of the specimen at position A8.

Figures 147A, 147B, 147C:
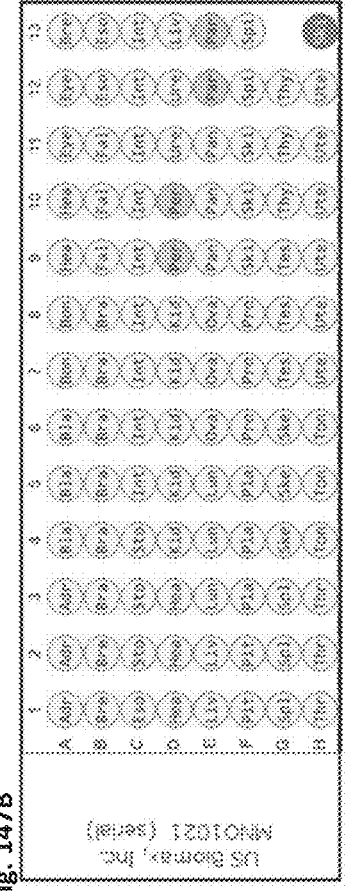

FIG. 147A-147C shows photographs, array map and description of FDA normal tissue array 1021 stained with the anti-PSMGFR antibody 25E6 at 5.0 ug/mL. FIG. 147A shows photographs of the tissue micro array. FIG. 147B shows map of the array with abbreviated tissue descriptors. FIG. 147C detailed description of the tissue micro array with non-identifying donor data.

Figures 148I, 148J, 148K, 148L, 148M, 148N, 148O, 148P:
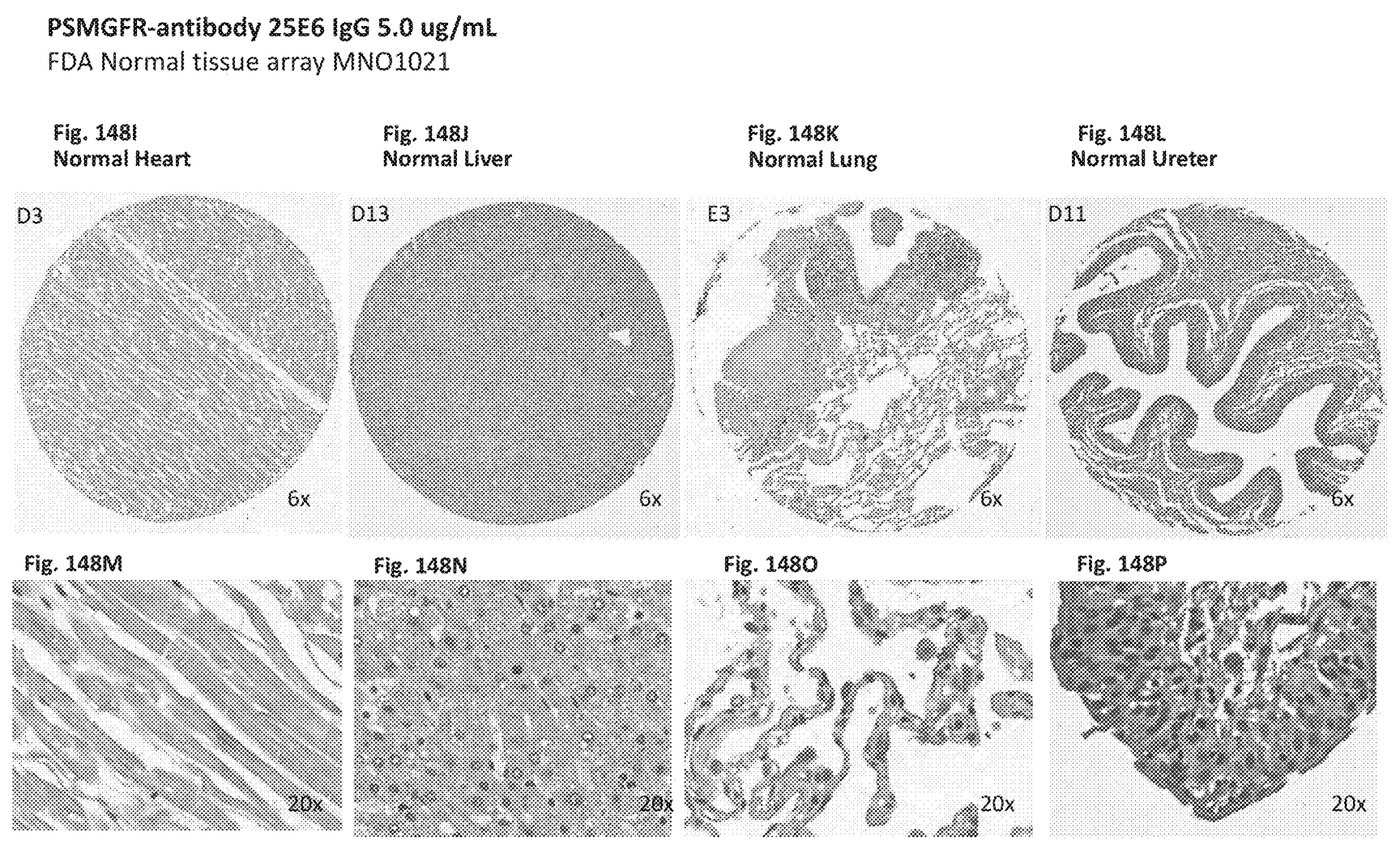

FIG. 148A-148X shows photographs of specific tissues from FDA normal tissue array 1021 stained with the anti-PSMGFR antibody 25E6 at 5.0 ug/mL, magnified to 6× and 20×. FIG. 148A and FIG. 148E are adrenal gland. FIG. 148B and FIG. 148F are breast. FIG. 148C and FIG. 148G are fallopian tube. FIG. 148D and FIG. 148H are kidney. FIG. 148I and FIG. 148M are heart muscle. FIG. 148J and FIG.

148N are liver. FIG. 148K and FIG. 148O are lung. FIG. 148L and FIG. 148P are ureter. FIG. 148Q and FIG. 148U are eye. FIG. 148R and FIG. 148V are cerebral cortex. FIG. 148S and FIG. 148W are bone marrow. FIG. 148T and FIG. 148X are skeletal muscle.

Figures 149A, 149B, 149C:
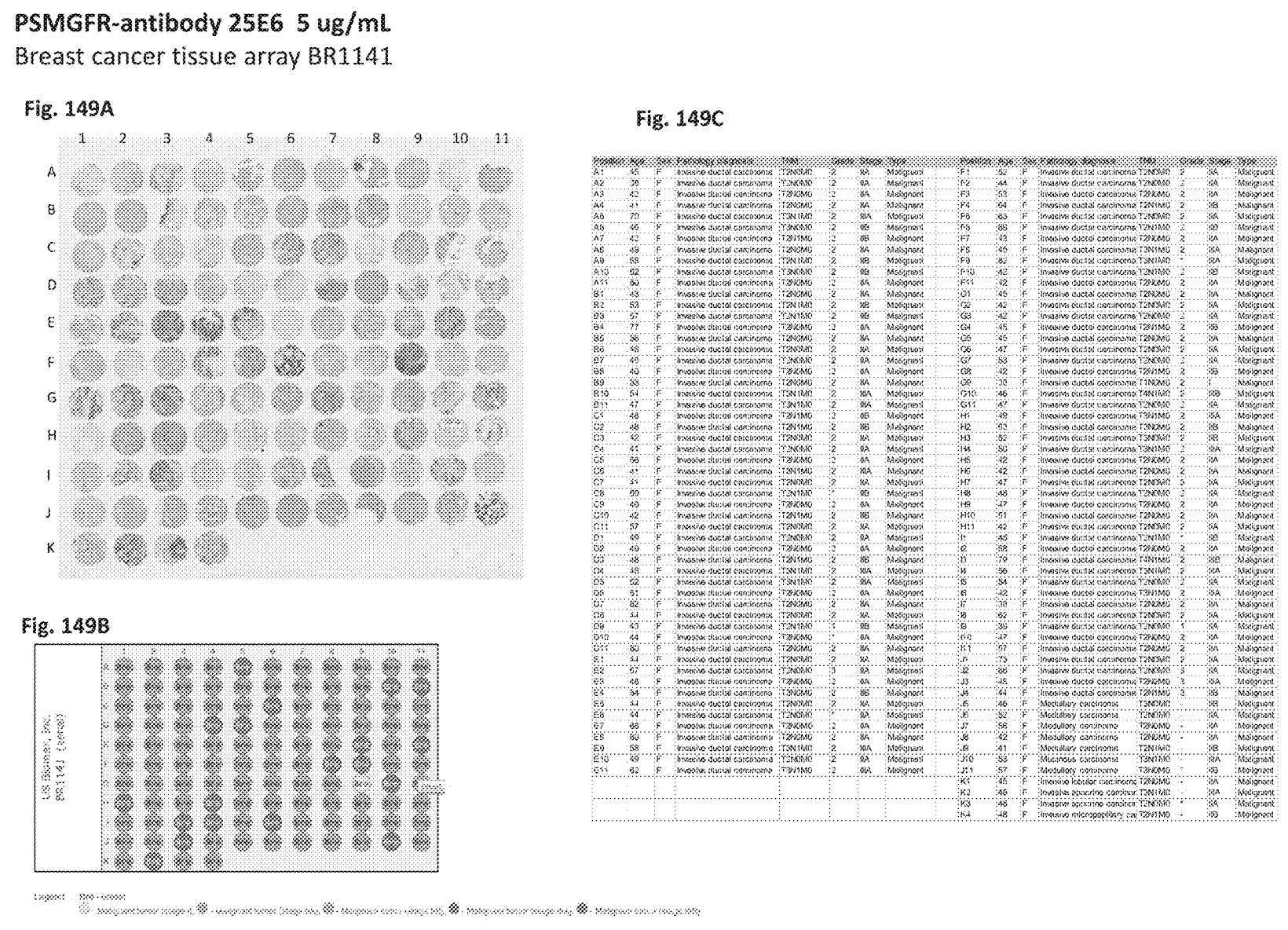

FIG. 149A-149C shows photographs, array map and description of breast cancer tissue array 1141 stained with the anti-PSMGFR antibody 25E6 at 5.0 ug/mL. FIG. 149A shows photographs of the tissue micro array. FIG. 149B shows map of the array with abbreviated tissue descriptors. FIG. 149C detailed description of the tissue micro array with non-identifying donor data.

FIG. 150A-150F shows photographs of specific tissues from breast cancer tissue array 1141 stained with the anti-PSMGFR antibody 25E6 at 5.0 ug/mL, magnified to 6× and 20×. FIG. 150A and FIG. 150D are photographs of a Grade 2 invasive ductal carcinoma. FIG. 150B and FIG. 150E are photographs of a Grade 2 invasive ductal carcinoma. FIG. 150C and FIG. 150F are photographs of a Grade 2 invasive ductal carcinoma.

Figures 151A, 151B, 151C:
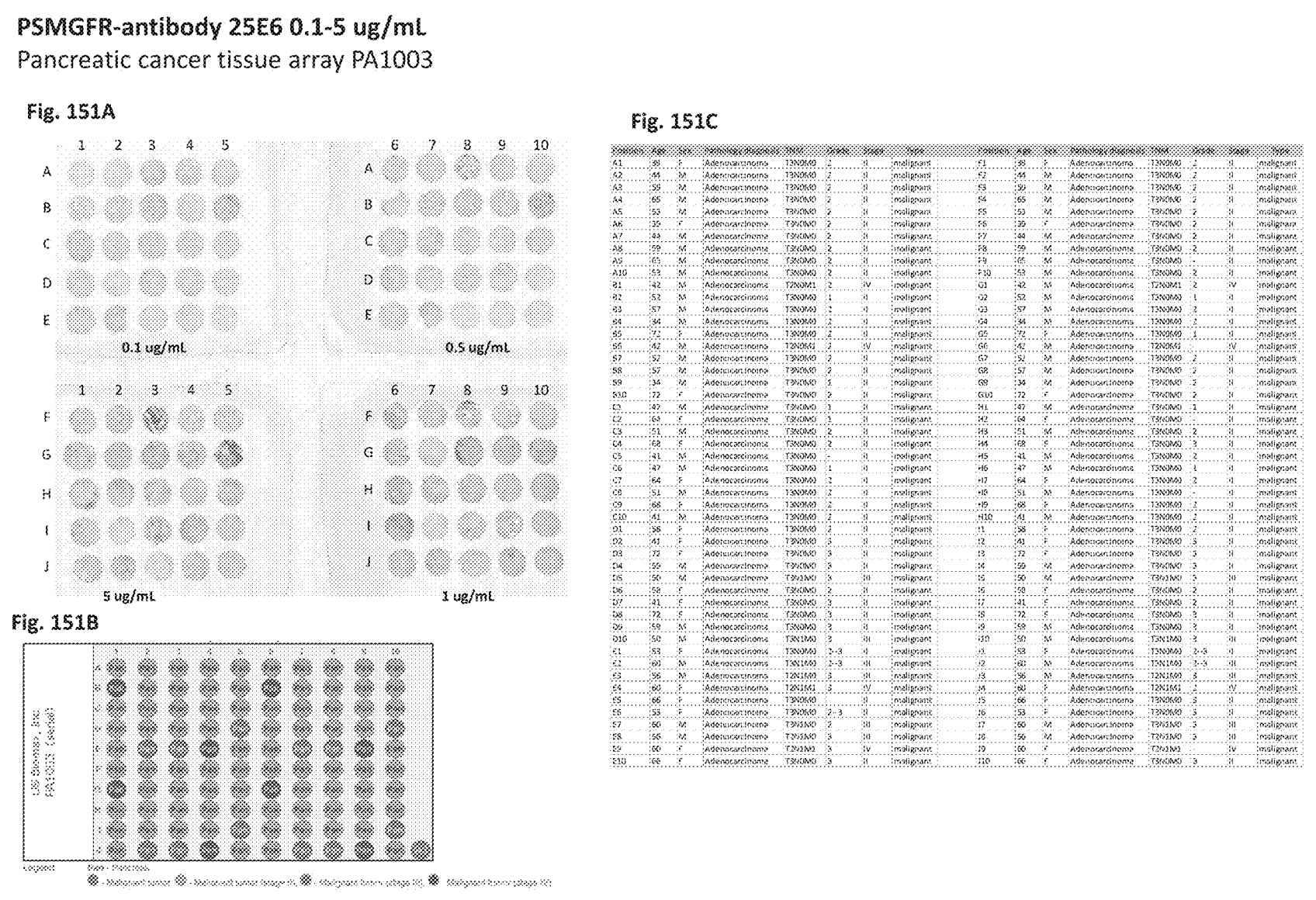

FIG. 151A-151C shows photographs, array map and description of pancreatic cancer tissue array PA1003 stained with the anti-PSMGFR antibody 25E6 at 5.0 ug/mL. FIG. 151A shows photographs of the tissue micro array. FIG. 151B shows map of the array with abbreviated tissue descriptors. FIG. 151C detailed description of the tissue micro array with non-identifying donor data.

Figures 152A, 152B, 152C, 152D, 152E, 152F:
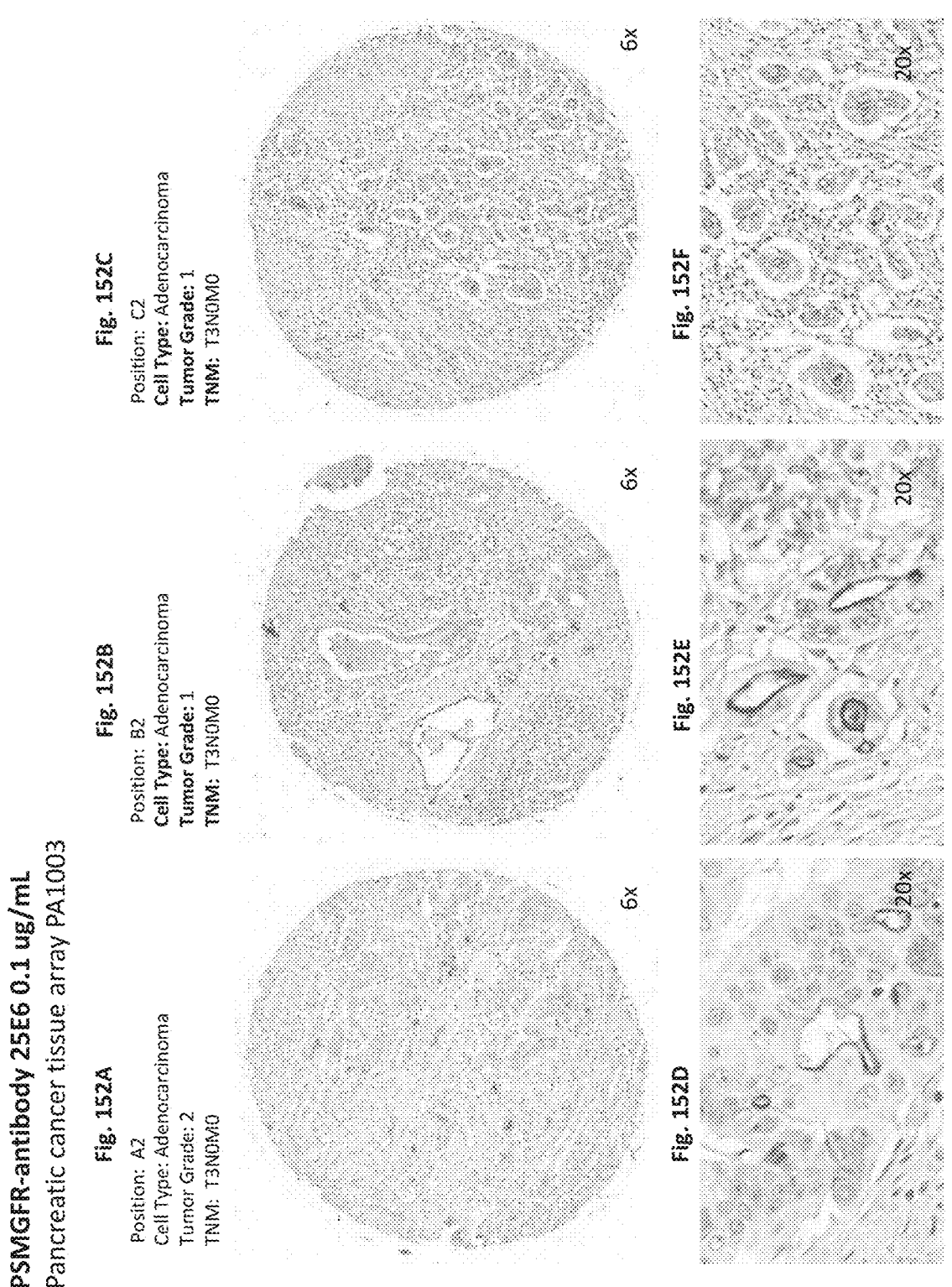

FIG. 152A-152F shows photographs of specific tissues from pancreatic cancer tissue array PA1003 stained with the anti-PSMGFR antibody 25E6 at 5.0 ug/mL, magnified to 6× and 20×. FIG. 152A and FIG. 152D are photographs of a Grade 2 adenocarcinoma. FIG. 152B and FIG. 152E are photographs of a Grade 1 adenocarcinoma. FIG. 152C and FIG. 152F are photographs of a Grade 1 adenocarcinoma.

Figures 153A, 153B, 153C:
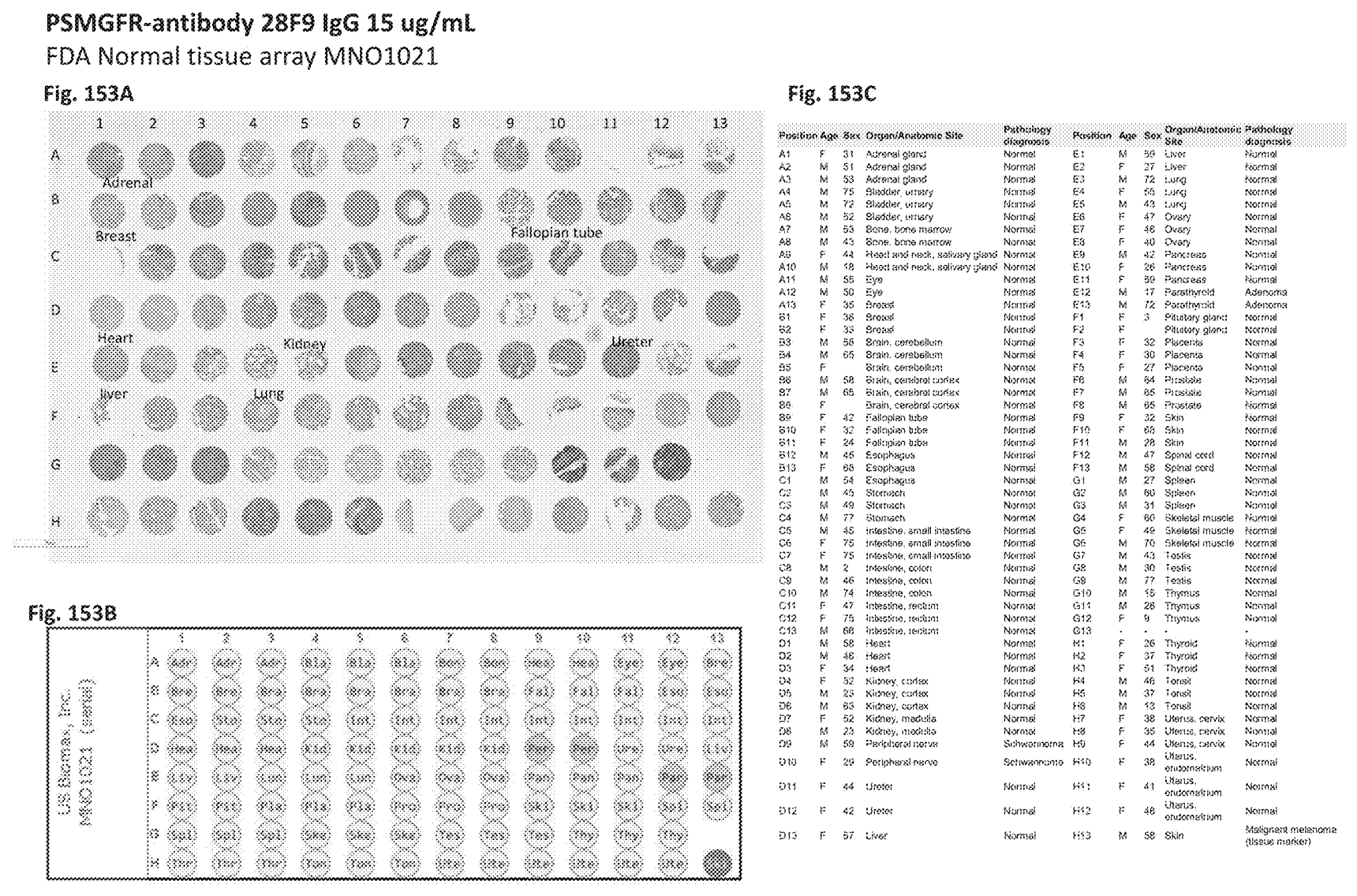

FIG. 153A-153C shows photographs, array map and description of FDA normal tissue array 1021 stained with the anti-PSMGFR antibody 28F9 at 15.0 ug/mL. FIG. 153A shows photographs of the tissue micro array. FIG. 153B shows map of the array with abbreviated tissue descriptors. FIG. 153C detailed description of the tissue micro array with non-identifying donor data.

Figures 154I, 154J, 154K, 154L, 154M, 154N, 154O, 154P:
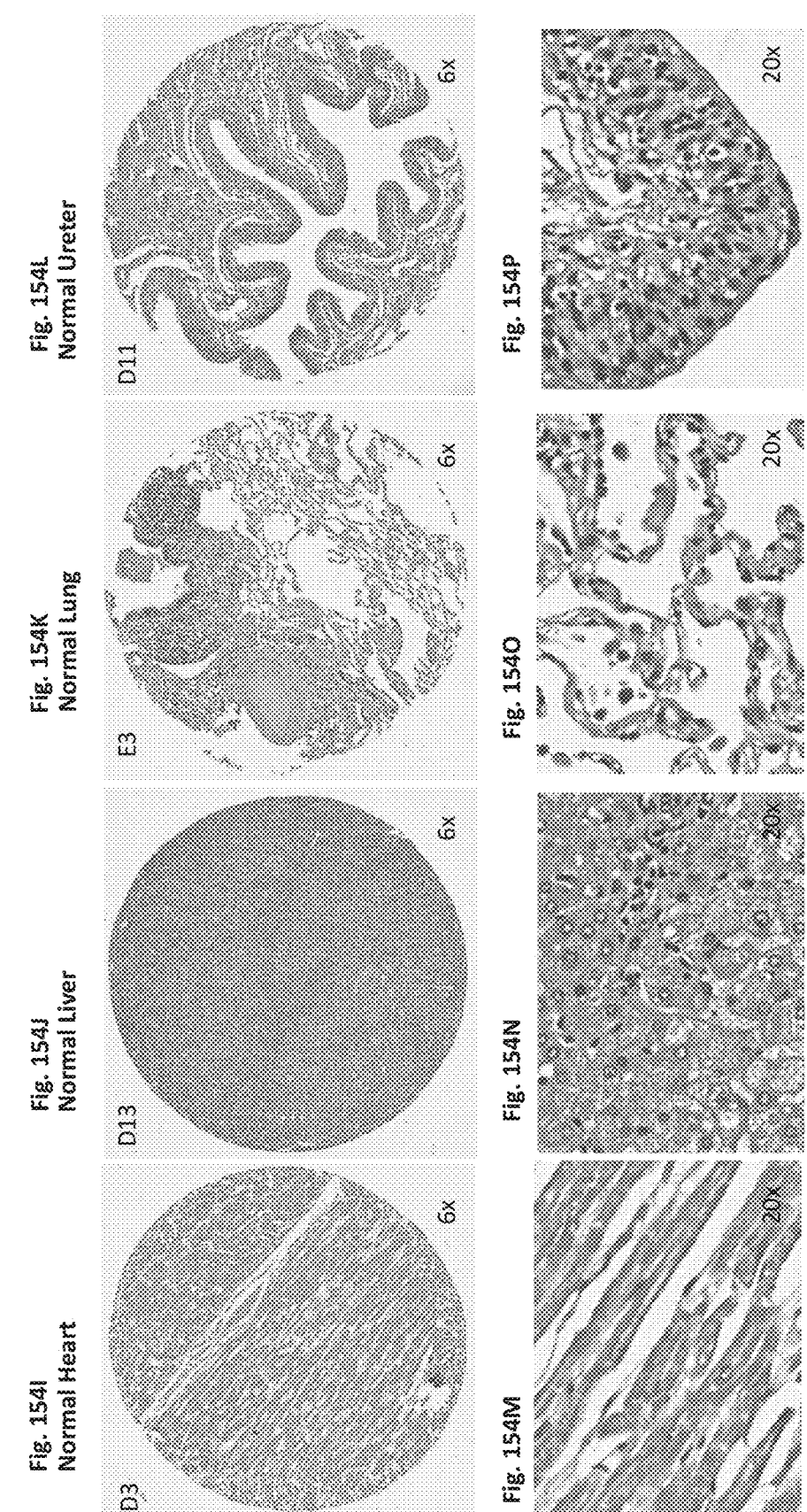
Figures 154Q, 154R, 154S, 154T, 154U, 154V, 154W, 154X:
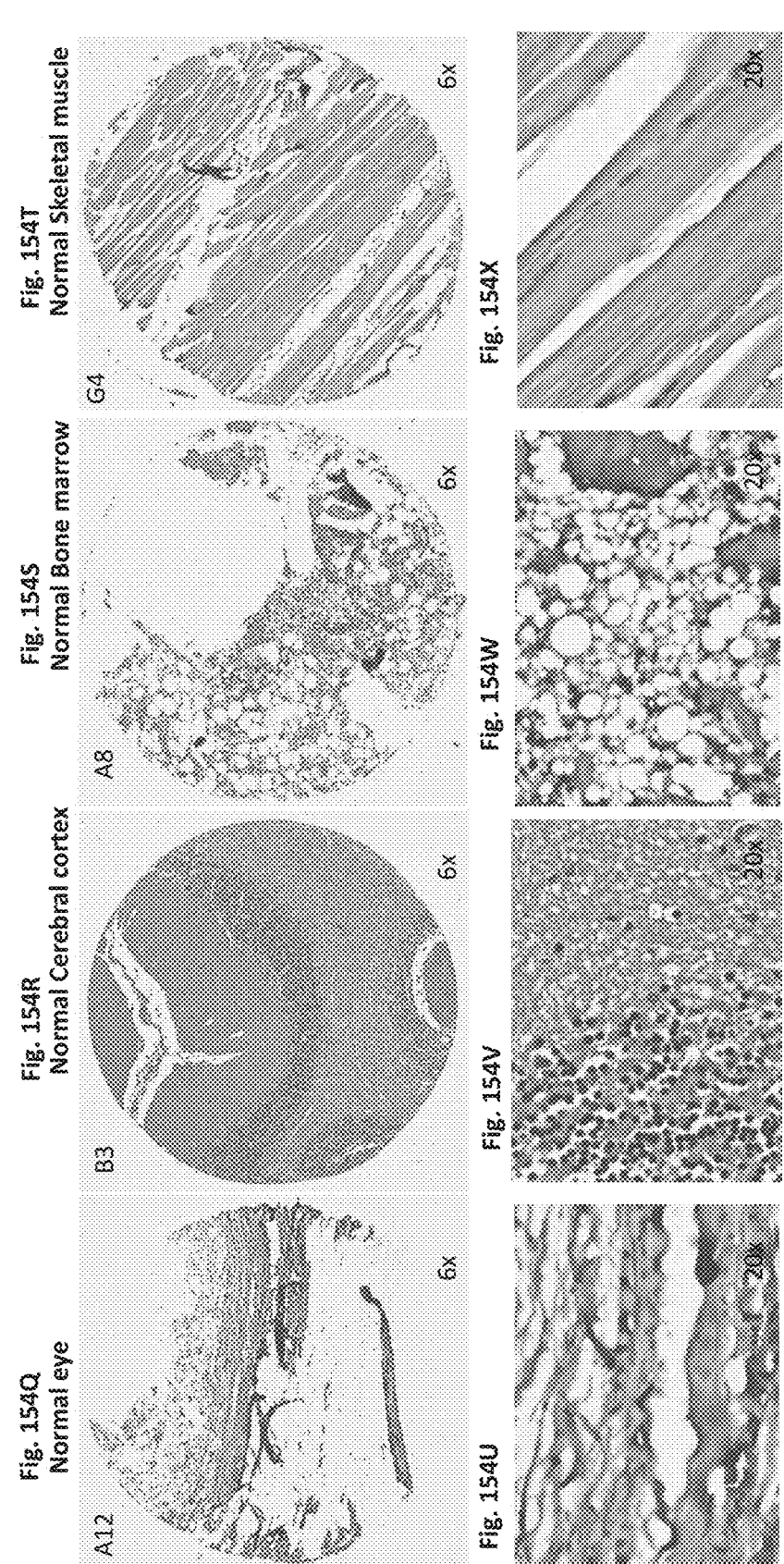

FIG. 154A-154X shows photographs of specific tissues from FDA normal tissue array 1021 stained with the anti-PSMGFR antibody 28F9 at 15.0 ug/mL, magnified to 6× and 20×. FIG. 154A and FIG. 154E are adrenal gland. FIG. 154B and FIG. 154F are breast. FIG. 154C and FIG. 154G are fallopian tube. FIG. 154D and FIG. 154H are kidney. FIG. 154I and FIG. 154M are heart muscle. FIG. 154J and FIG. 154N are liver. FIG. 154K and FIG. 154O are lung. FIG. 154L and FIG. 154P are ureter. FIG. 154Q and FIG. 154U are eye. FIG. 154R and FIG. 154V are cerebral cortex. FIG. 154S and FIG. 154W are bone marrow. FIG. 154T and FIG. 154X are skeletal muscle.

Figures 155A, 155B, 155C:
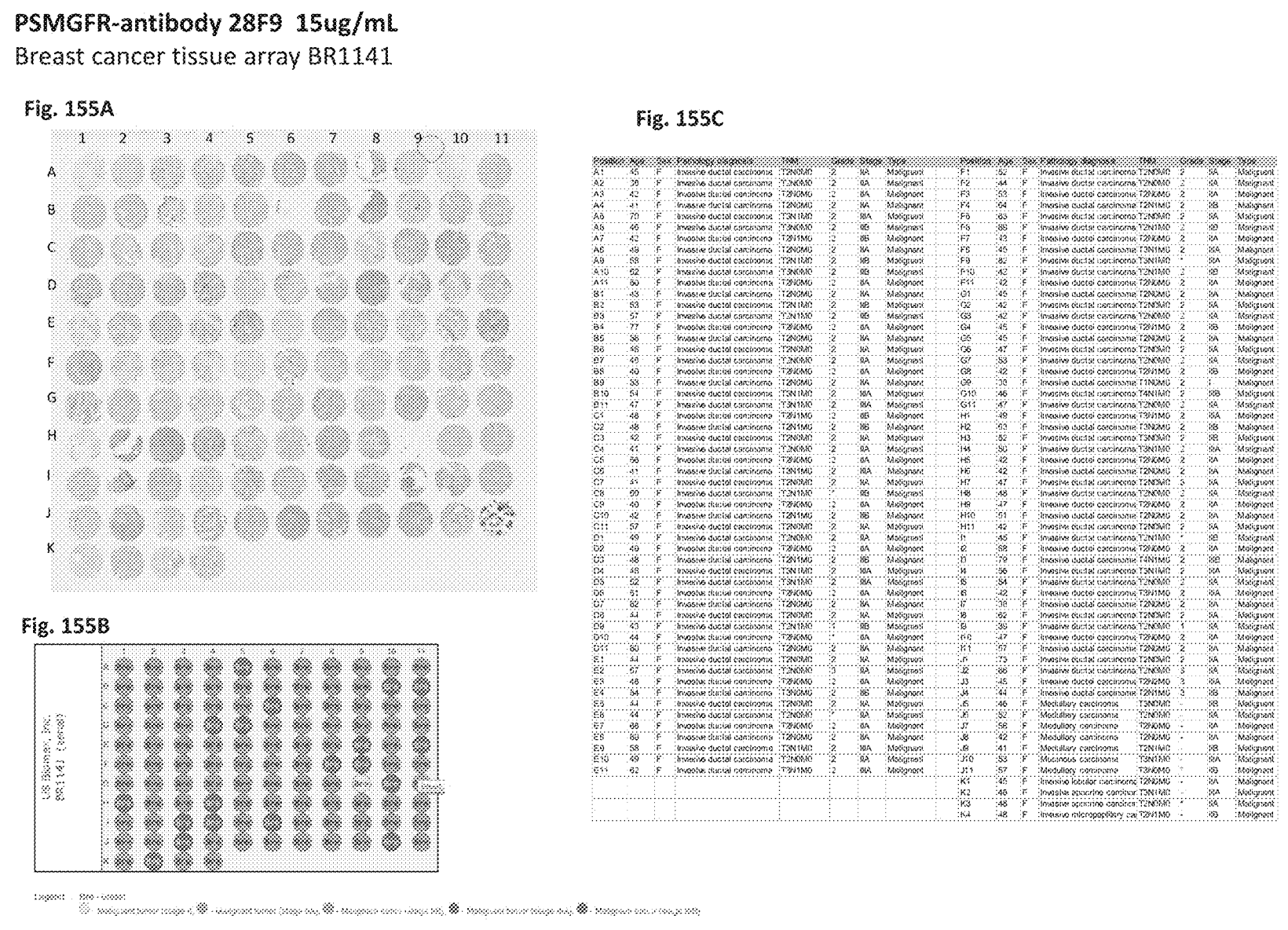

FIG. 155A-155C shows photographs, array map and description of breast cancer tissue array 1141 stained with the anti-PSMGFR antibody 28F9 at 15.0 ug/mL. FIG. 155A shows photographs of the tissue micro array. FIG. 155B shows map of the array with abbreviated tissue descriptors. FIG. 155C detailed description of the tissue micro array with non-identifying donor data.

Figures 156A, 156B, 156C, 156D, 156E, 156F:
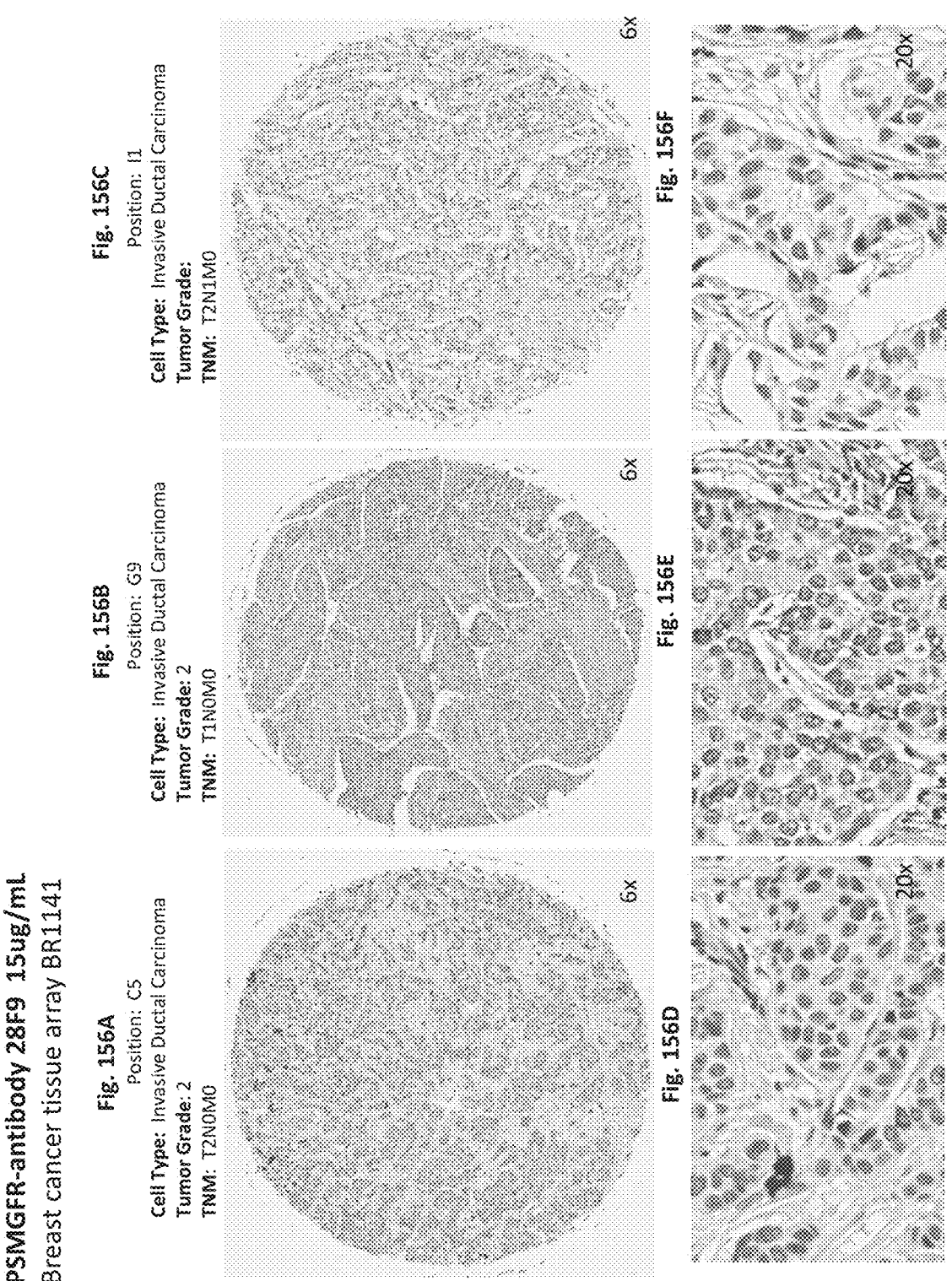

FIG. 156A-156F shows photographs of specific tissues from breast cancer tissue array 1141 stained with the anti-PSMGFR antibody 28F9 at 15.0 ug/mL, magnified to 6× and 20×. FIG. 156A and FIG. 156D are photographs of a Grade 2 invasive ductal carcinoma. FIG. 156B and FIG. 156E are photographs of a Grade 2 invasive ductal carcinoma. FIG. 156C and FIG. 156F are photographs of a Grade 2 invasive ductal carcinoma.

FIG. 157A-157C shows photographs, array map and description of FDA normal tissue array 1021 stained with the N+20/C-27 antibody 1E4 at 7.5 ug/mL. FIG. 157A shows photographs of the tissue micro array. FIG. 157B shows map of the array with abbreviated tissue descriptors. FIG. 157C detailed description of the tissue micro array with non-identifying donor data.

Figures 158I, 158J, 158K, 158L, 158M, 158N, 158O, 158P:
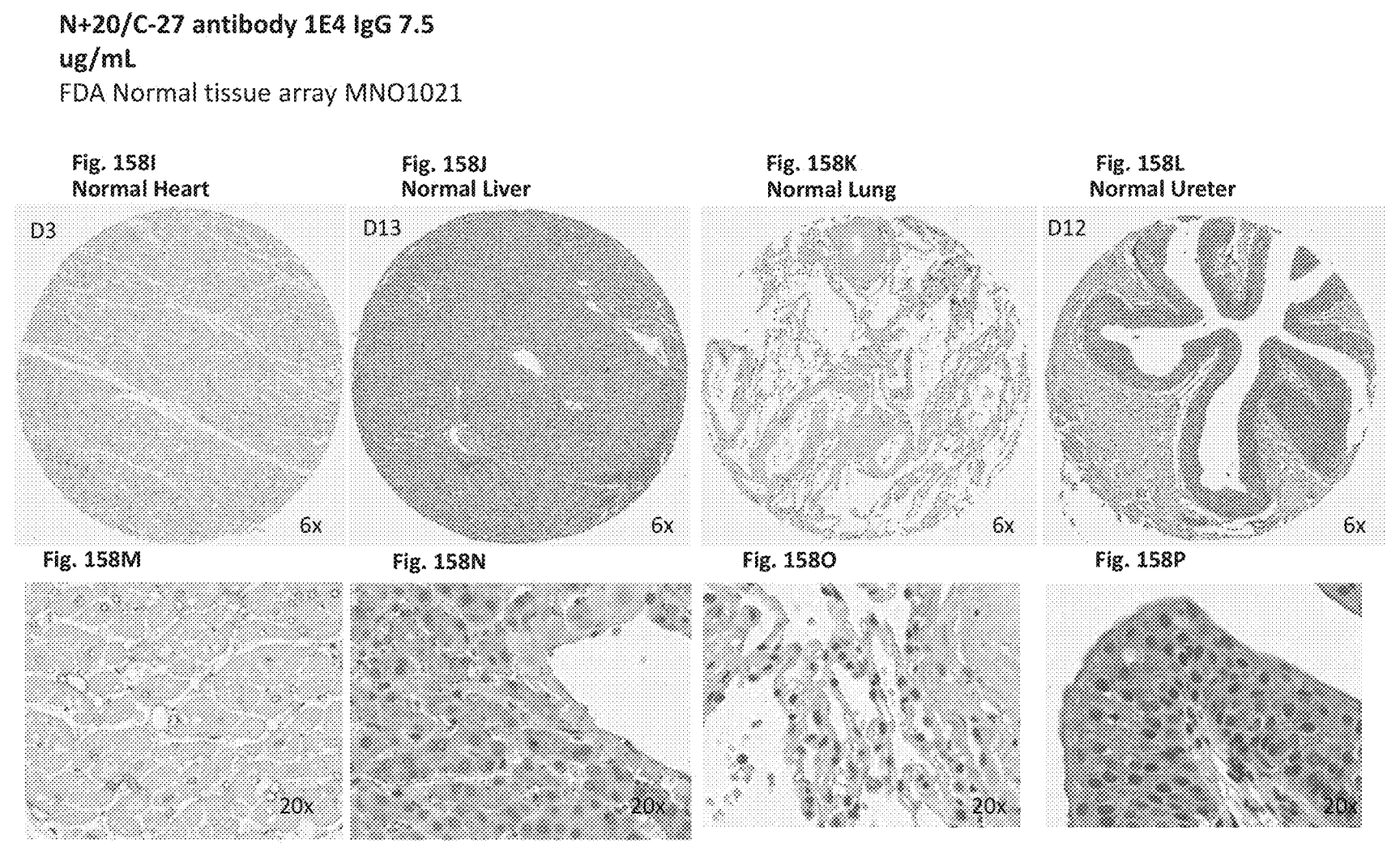

FIG. 158A-158X shows photographs of specific tissues from FDA normal tissue array 1021 stained with the N+20/C-27 antibody 1E4 at 7.5 ug/mL, magnified to 6× and 20×. FIG. 158A and FIG. 158E are adrenal gland. FIG. 158B and FIG. 158F are breast. FIG. 158C and FIG. 158G are fallopian tube. FIG. 158D and FIG. 158H are kidney. FIG. 158I and FIG. 158M are heart muscle. FIG. 158J and FIG. 158N are liver. FIG. 158K and FIG. 158O are lung. FIG. 158L and FIG. 158P are ureter. FIG. 158Q and FIG. 158U are eye. FIG. 158R and FIG. 158V are cerebral cortex. FIG. 158S and FIG. 158W are bone marrow. FIG. 158T and FIG. 158X are skeletal muscle.

Figures 159A, 159B, 159C:
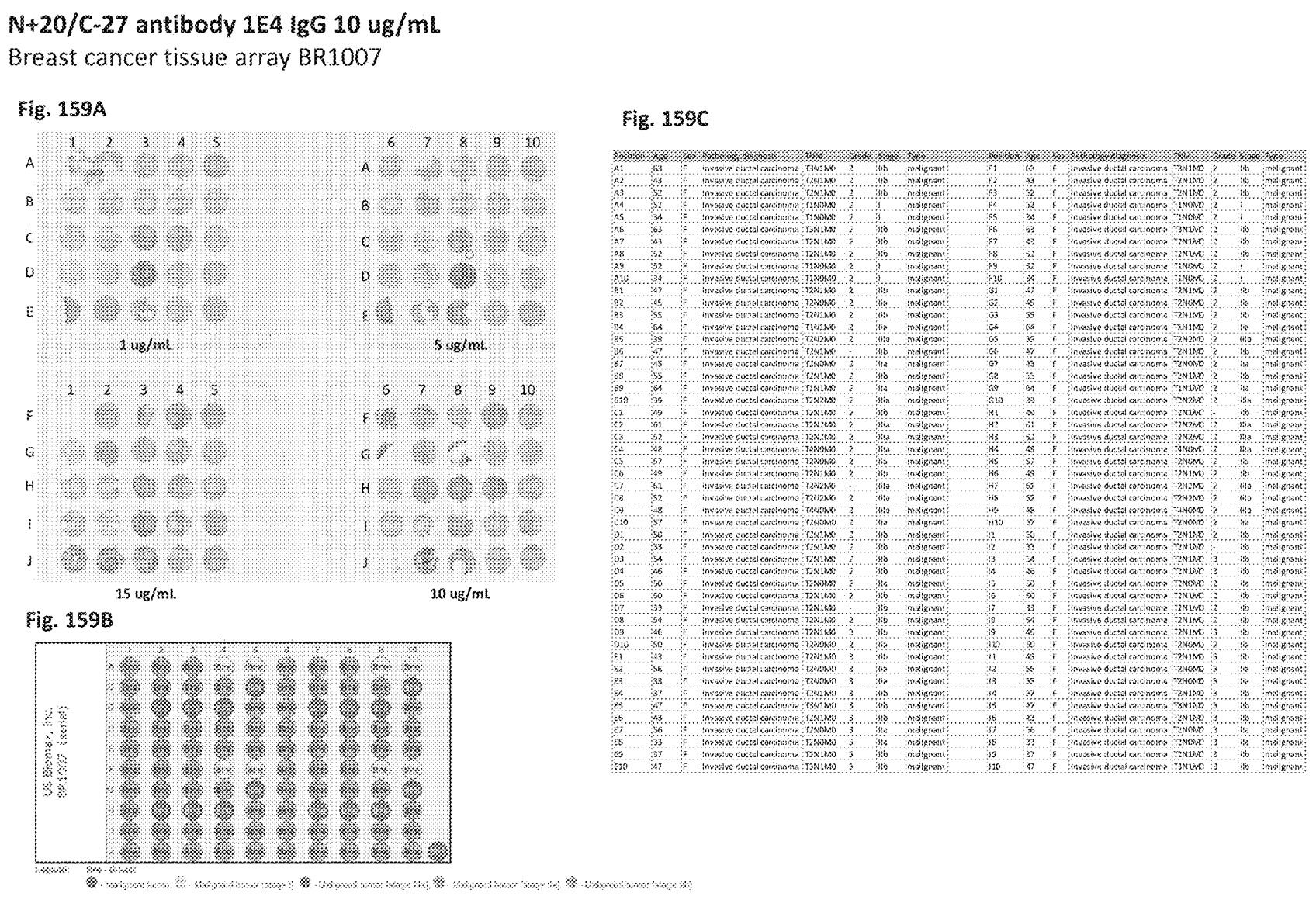

FIG. 159A-159C shows photographs, array map and description of breast cancer tissue array BR1007 stained with the N+20/C-27 antibody 1E4 at 10.0 ug/mL. FIG. 159A shows photographs of the tissue micro array. FIG. 159B shows map of the array with abbreviated tissue descriptors. FIG. 159C detailed description of the tissue micro array with non-identifying donor data.

Figures 160A, 160B, 160C, 160D, 160E, 160F:
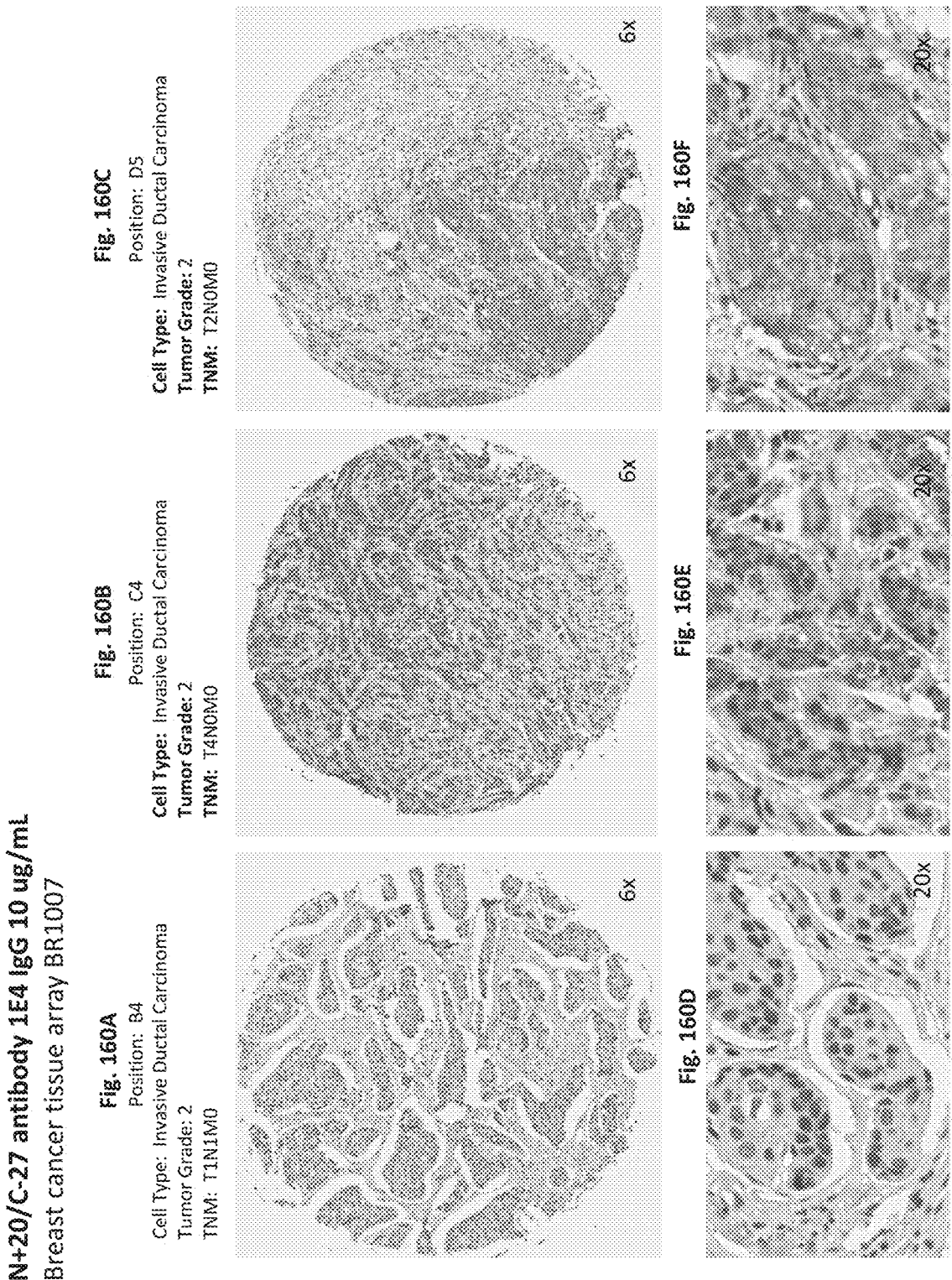

FIG. 160A-160F shows photographs of specific tissues from breast cancer tissue array BR1007 stained with the N+20/C-27 antibody 1E4 at 10.0 ug/mL, magnified to 6× and 20×. FIG. 160A and FIG. 160D are photographs of a Grade 2 invasive ductal carcinoma with positive lymph nodes. FIG. 160B and FIG. 160E are photographs of a Grade 2 invasive ductal carcinoma. FIG. 160C and FIG. 160F are photographs of a Grade 2 invasive ductal carcinoma.

Figures 161A, 161B, 161C:
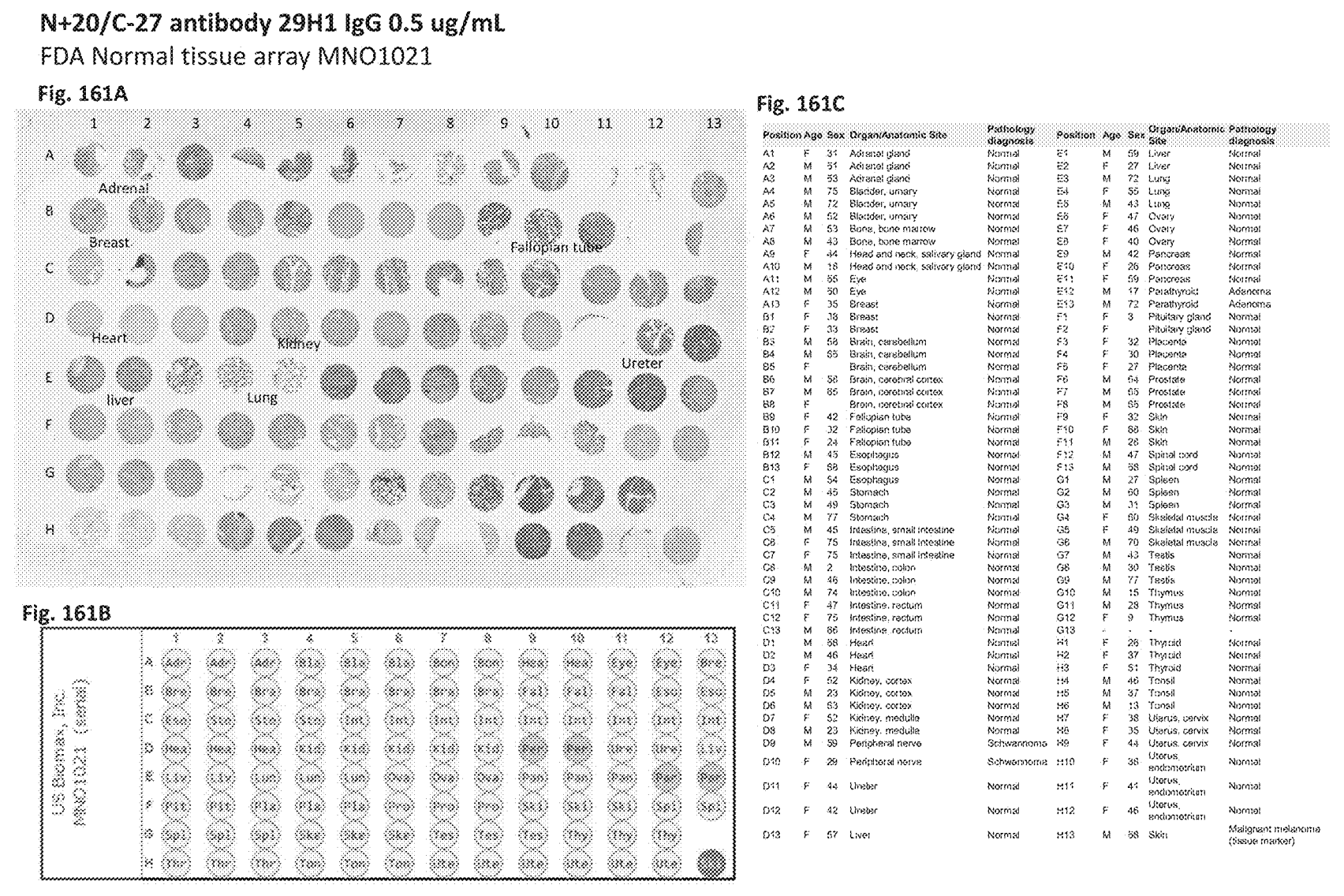

FIG. 161A-161C shows photographs, array map and description of FDA normal tissue array 1021 stained with the N+20/C-27 antibody 29H1 at 0.5 ug/mL. FIG. 161A shows photographs of the tissue micro array. FIG. 161B shows map of the array with abbreviated tissue descriptors. FIG. 161C detailed description of the tissue micro array with non-identifying donor data.

Figures 162I, 162J, 162K, 162L, 162M, 162N, 162O, 162P:
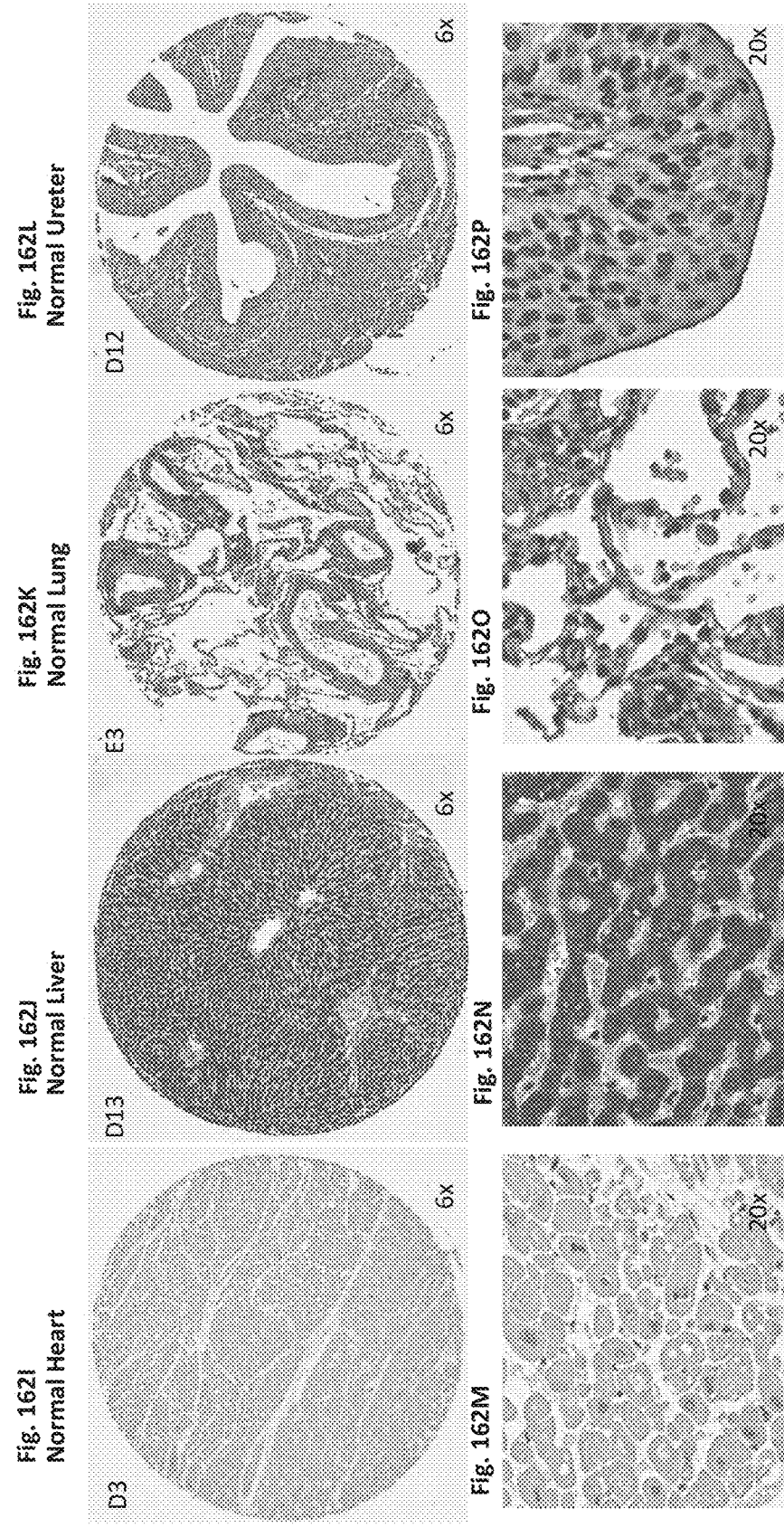

FIG. 162A-162X shows photographs of specific tissues from FDA normal tissue array 1021 stained with the N+20/C-27 antibody 29H1 at 0.5 ug/mL, magnified to 6× and 20×. FIG. 162A and FIG. 162E are adrenal gland. FIG. 162B and FIG. 162F are breast. FIG. 162C and FIG. 162G are fallopian tube. FIG. 162D and FIG. 162H are kidney. FIG. 162I and FIG. 162M are heart muscle. FIG. 162J and FIG. 162N are liver. FIG. 162K and FIG. 162O are lung. FIG. 162L and FIG. 162P are ureter. FIG. 162Q and FIG. 162U are eye. FIG. 162R and FIG. 162V are cerebral cortex. FIG. 162S and FIG. 162W are bone marrow. FIG. 162T and FIG. 162X are skeletal muscle.

Figures 163A, 163B, 163C:
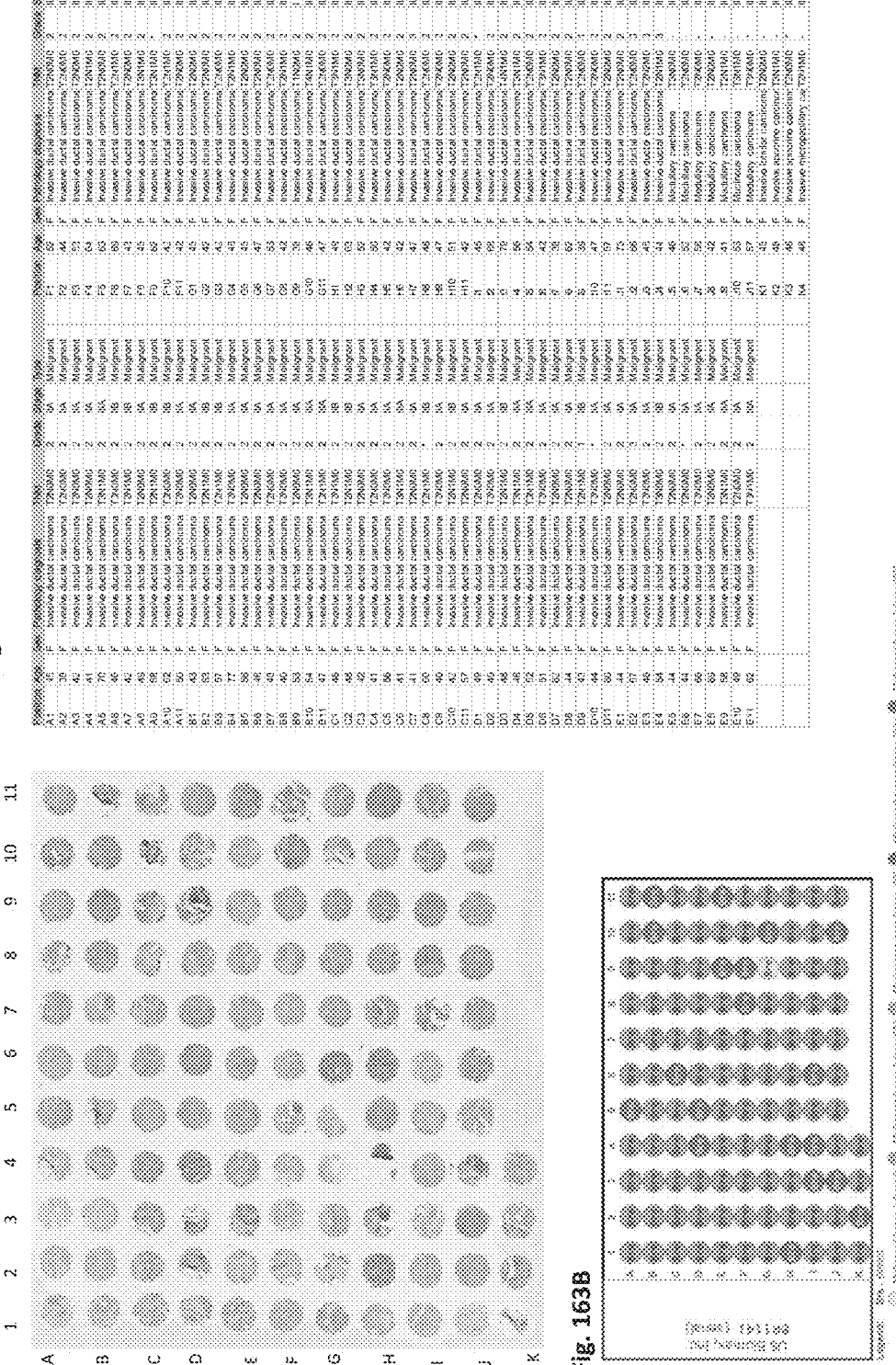

FIG. 163A-163C shows photographs, array map and description of breast cancer tissue array 1141 stained with the N+20/C-27 antibody 29H1 at 0.5 ug/mL. FIG. 163A shows photographs of the tissue micro array. FIG. 163B shows map of the array with abbreviated tissue descriptors. FIG. 163C detailed description of the tissue micro array with non-identifying donor data.

Figures 164D, 164E, 164F:
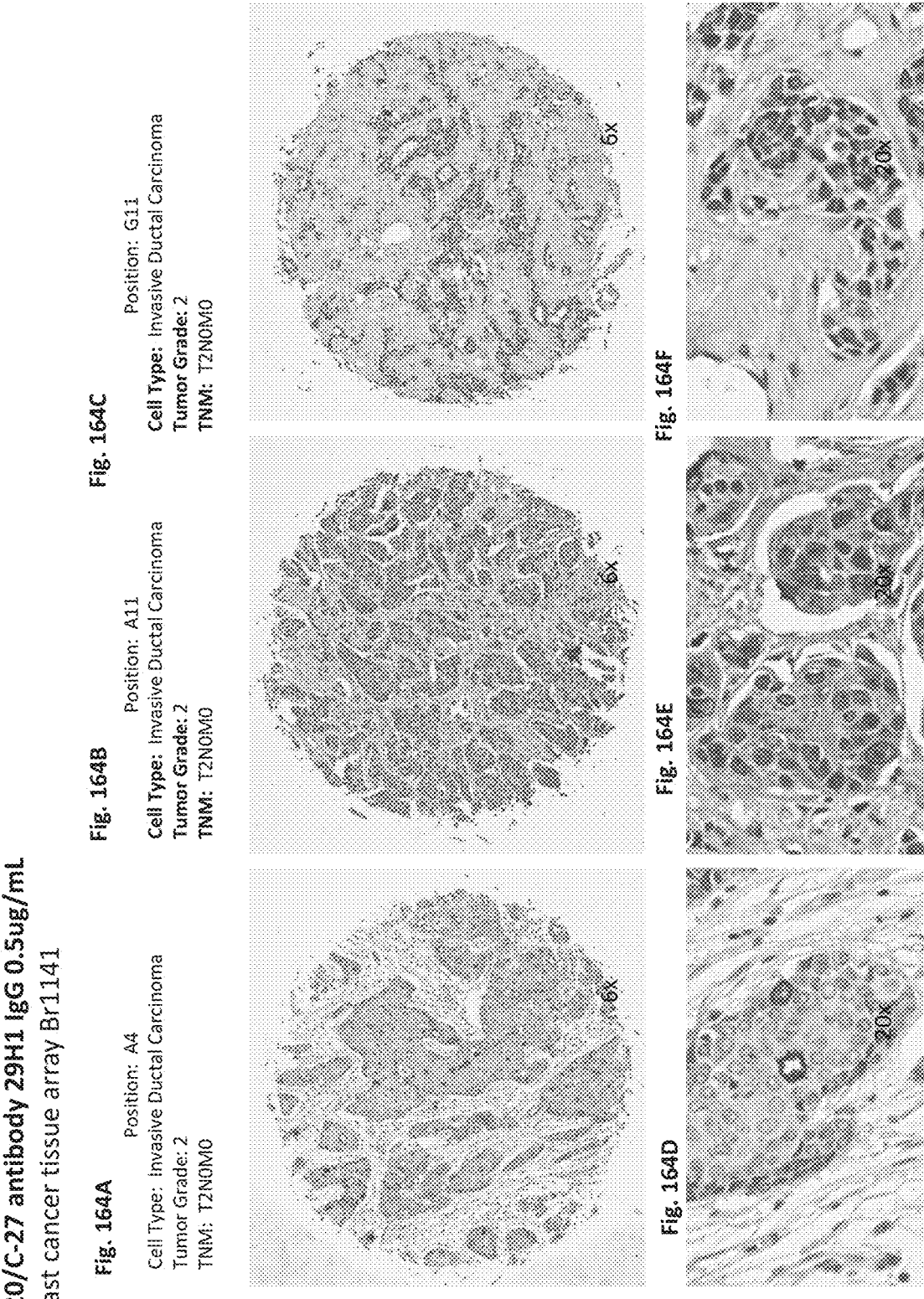

FIG. 164A-164F shows photographs of specific tissues from breast cancer tissue array 1141 stained with the N+20/C-27 antibody 29H1 at 0.5 ug/mL, magnified to 6× and 20×. FIG. 164A and FIG. 164D are photographs of a Grade 2 invasive ductal carcinoma. FIG. 164B and FIG. 164E are photographs of a Grade 2 invasive ductal carcinoma. FIG. 164C and FIG. 164F are photographs of a Grade 2 invasive ductal carcinoma.

Figures 165A, 165B, 165C:
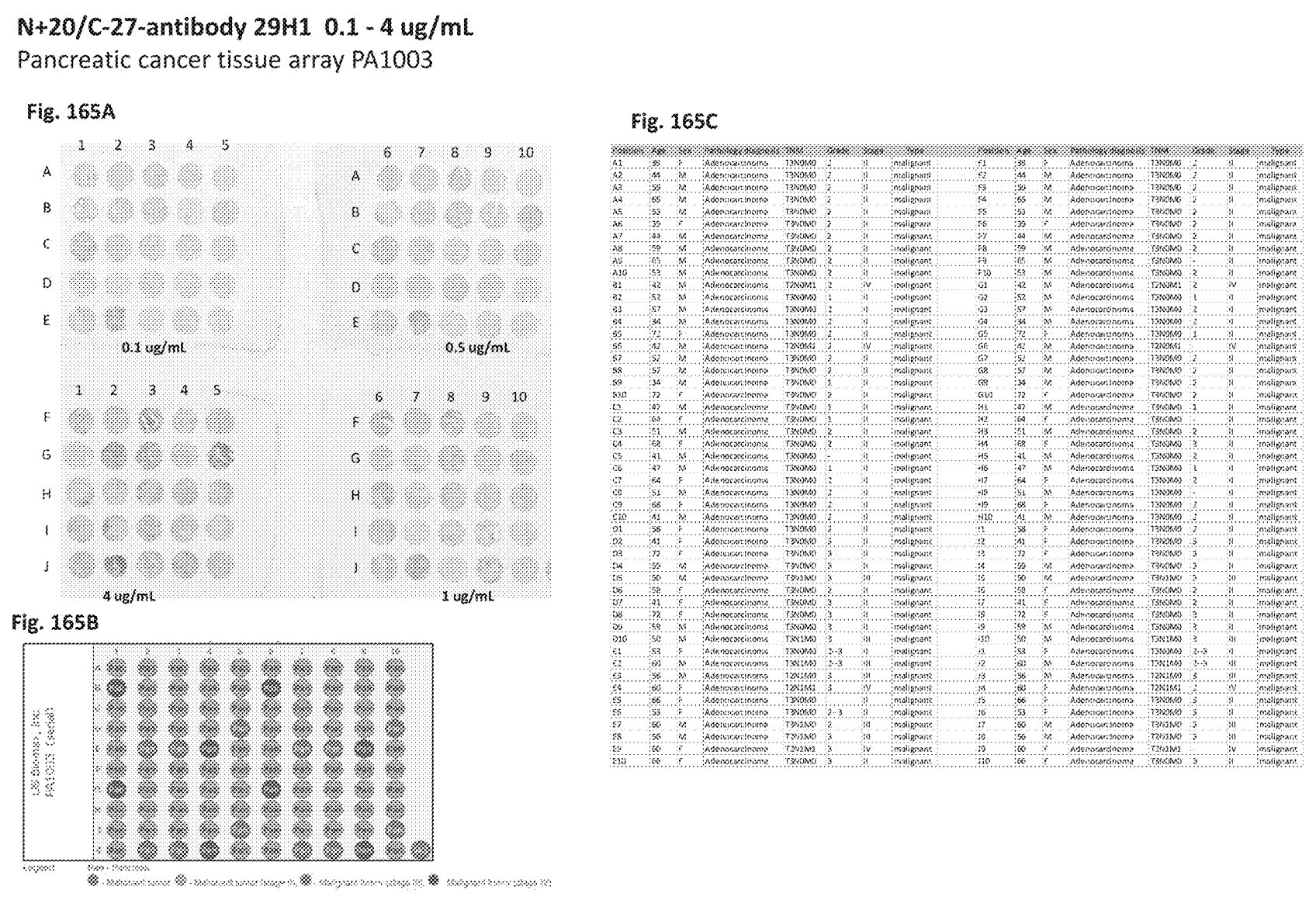

FIG. 165A-165C shows photographs, array map and description of pancreatic cancer tissue array PA1003 stained with the N+20/C-27 antibody 29H1 at 0.5 ug/mL. FIG. 165A shows photographs of the tissue micro array. FIG. 165B shows map of the array with abbreviated tissue descriptors. FIG. 165C detailed description of the tissue micro array with non-identifying donor data.

FIG. 166A-166F shows photographs of specific tissues from pancreatic cancer tissue array PA1003 stained with the N+20/C-27 antibody 29H1 at 0.5 ug/mL, magnified to 6× and 20×. FIG. 166A and FIG. 166D are photographs of a Grade 2 adenocarcinoma. FIG. 166B and FIG. 166E are photographs of a Grade 2 adenocarcinoma. FIG. 166C and FIG. 166F are photographs of a Grade 3 adenocarcinoma.

FIG. 167A-167C shows photographs, array map and description of FDA normal tissue array 1021 stained with the N+20/C-27 antibody 31A1 at 0.5 ug/mL. FIG. 167A shows photographs of the tissue micro array. FIG. 167B shows map of the array with abbreviated tissue descriptors. FIG. 167C detailed description of the tissue micro array with non-identifying donor data.

Figures 168A, 168B, 168C, 168D, 168E, 168F, 168G, 168H:
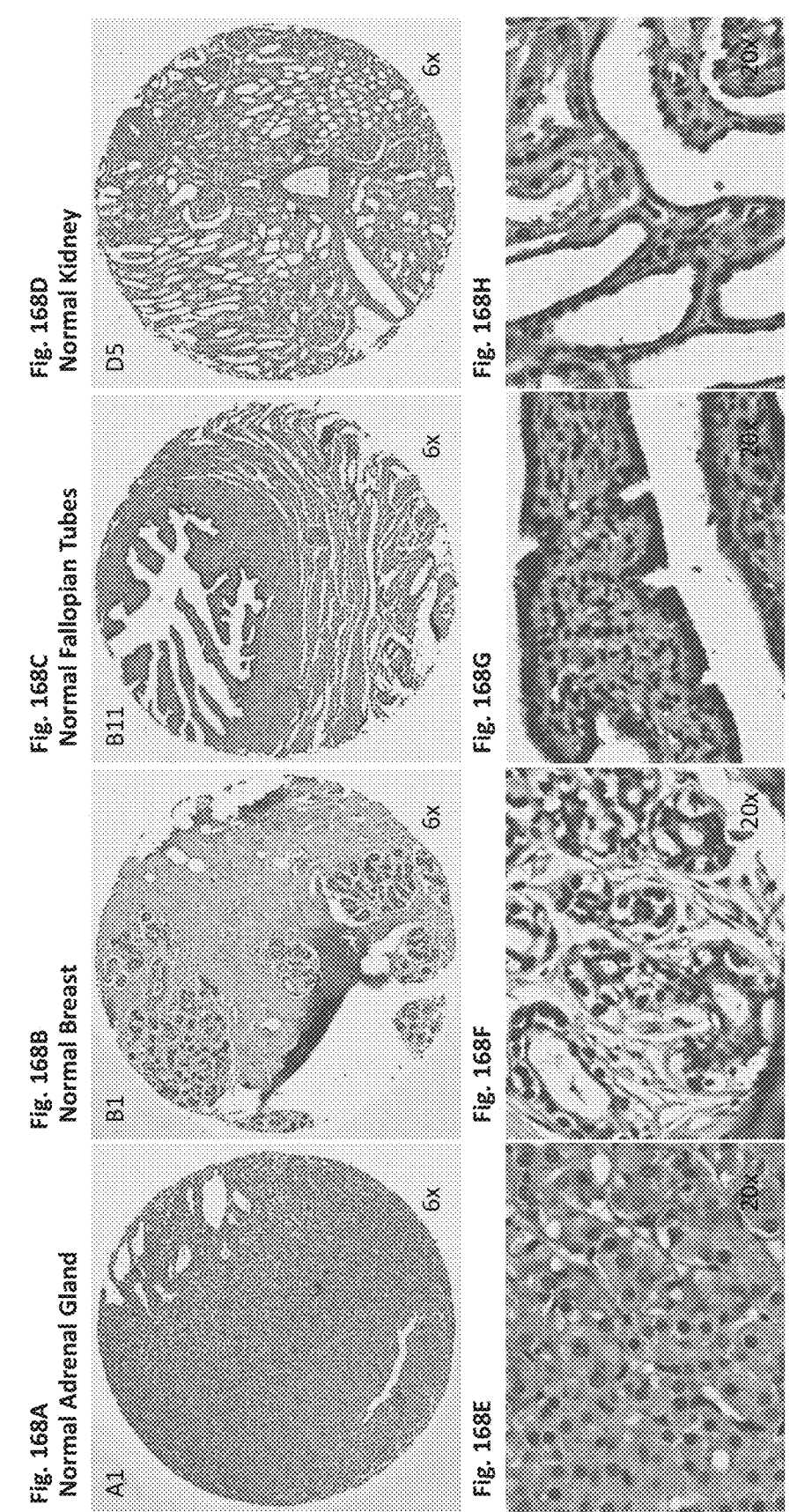
Figures 168Q, 168R, 168S, 168T, 168U, 168V, 168W, 168X:
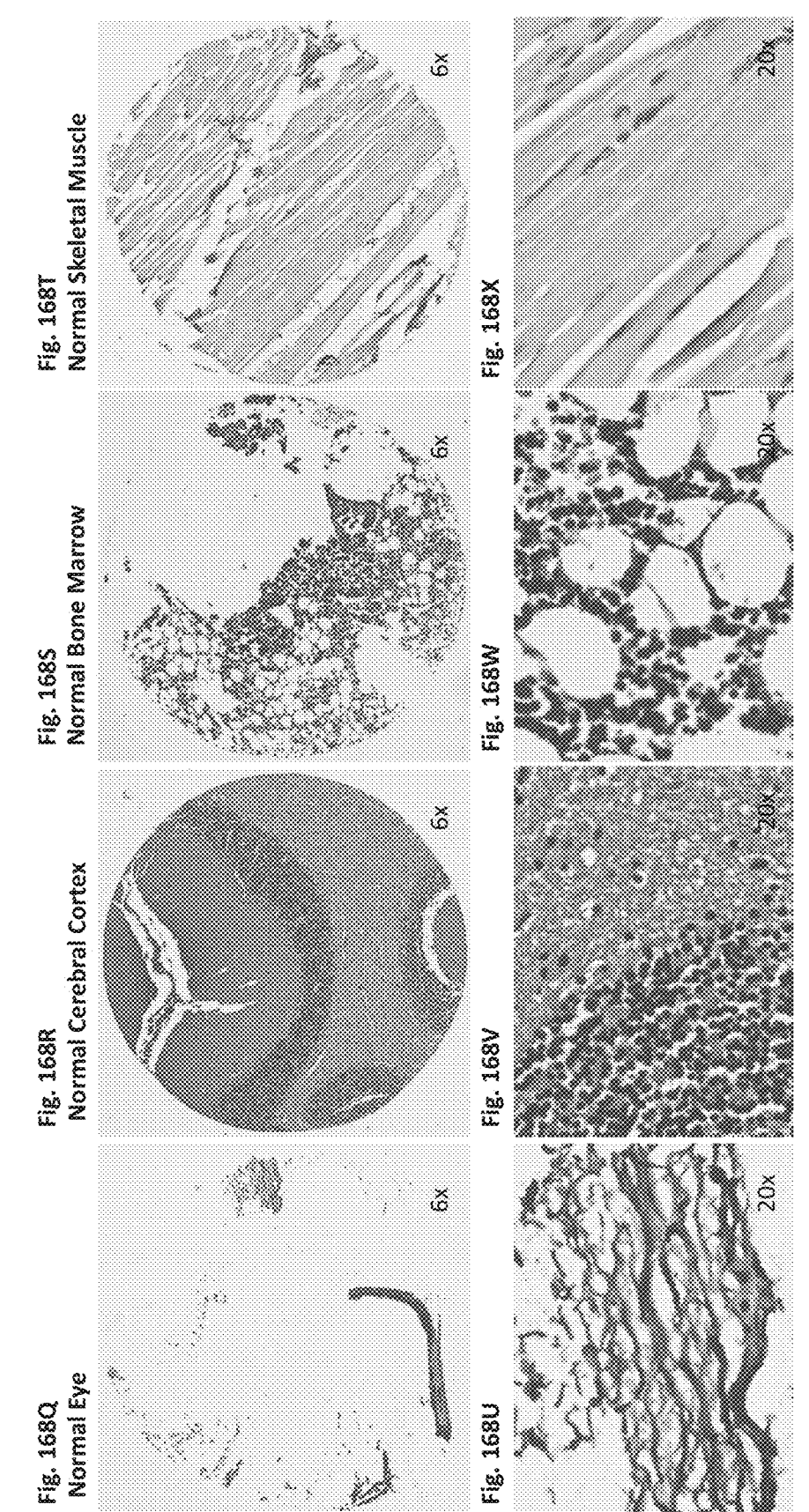

FIG. 168A-168X shows photographs of specific tissues from FDA normal tissue array 1021 stained with the N+20/C-27 antibody 31A1 at 0.5 ug/mL, magnified to 6× and 20×. FIG. 168A and FIG. 168E are adrenal gland. FIG. 168B and FIG. 168F are breast. FIG. 168C and FIG. 168G are fallopian tube. FIG. 168D and FIG. 168H are kidney. FIG. 168I and FIG. 168M are heart muscle. FIG. 168J and FIG. 168N are liver. FIG. 168K and FIG. 168O are lung. FIG. 168L and FIG. 168P are ureter. FIG. 168Q and FIG. 168U are eye. FIG. 168R and FIG. 168V are cerebral cortex. FIG. 168S and FIG. 168W are bone marrow. FIG. 168T and FIG. 168X are skeletal muscle.

Figures 169A, 169B, 169C:
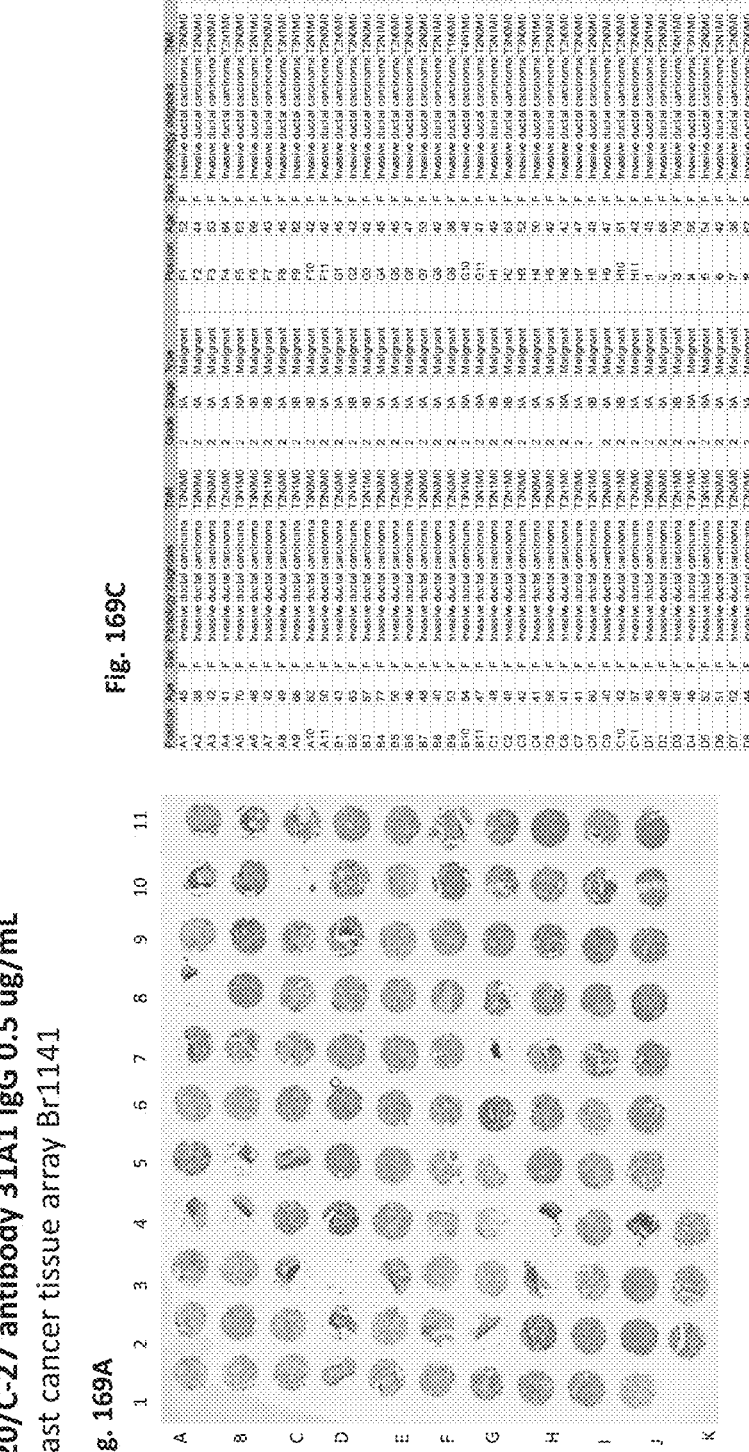

FIG. 169A-169C shows photographs, array map and description of breast cancer tissue array 1141 stained with the N+20/C-27 antibody 31A1 at 0.5 ug/mL. FIG. 169A shows photographs of the tissue micro array. FIG. 169B shows map of the array with abbreviated tissue descriptors. FIG. 169C detailed description of the tissue micro array with non-identifying donor data.

Figures 170A, 170B, 170C, 170D, 170E, 170F:
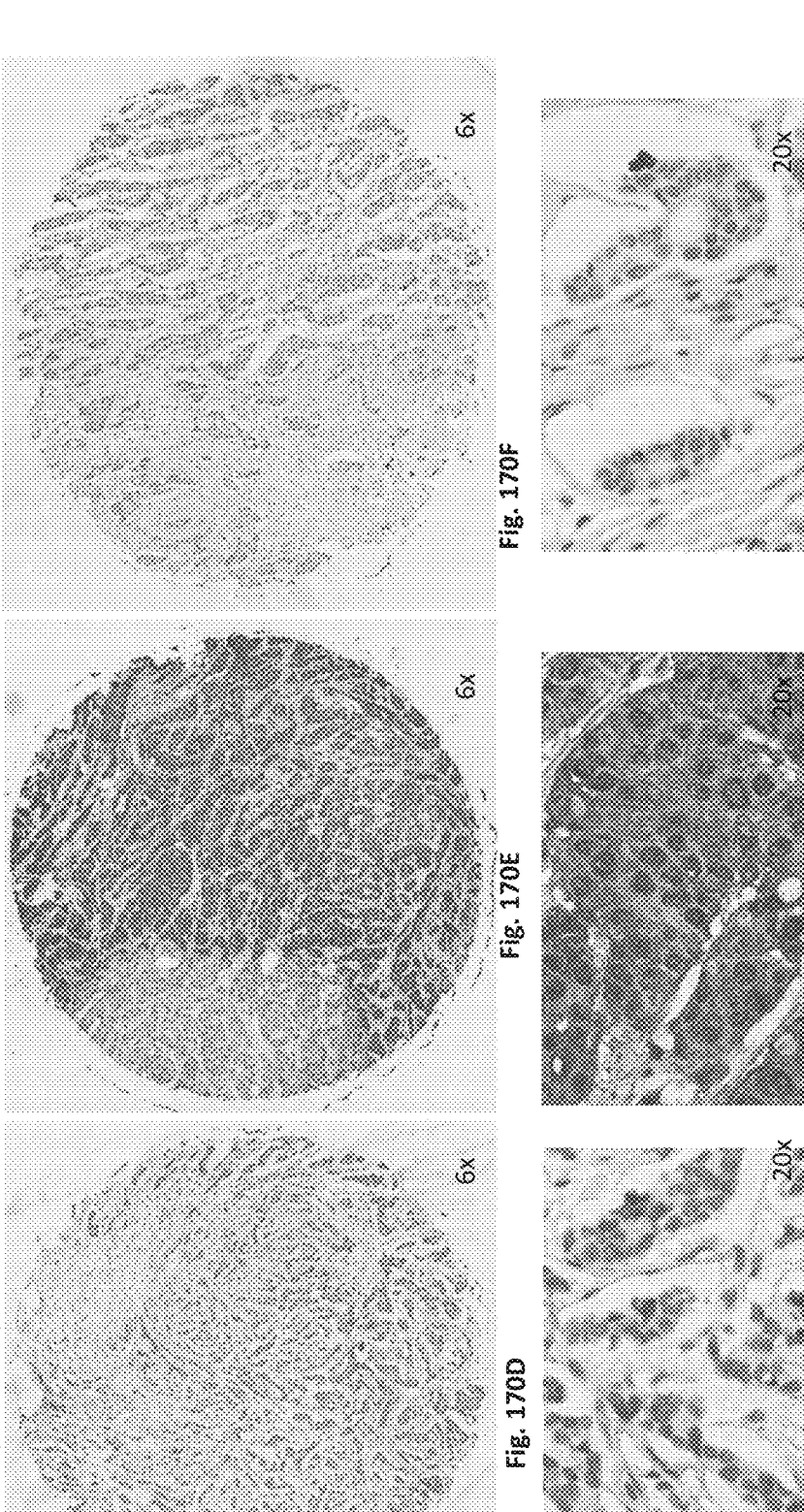

FIG. 170A-170F shows photographs of specific tissues from breast cancer tissue array 1141 stained with the N+20/C-27 antibody 31A1 at 0.5 ug/mL, magnified to 6× and 20×. FIG. 170A and FIG. 170D are photographs of a Grade 2 invasive ductal carcinoma. FIG. 170B and FIG. 170E are photographs of a Grade 2 invasive ductal carcinoma. FIG. 170C and FIG. 170F are photographs of a Grade 2 invasive ductal carcinoma.

Figures 171A, 171B, 171C:
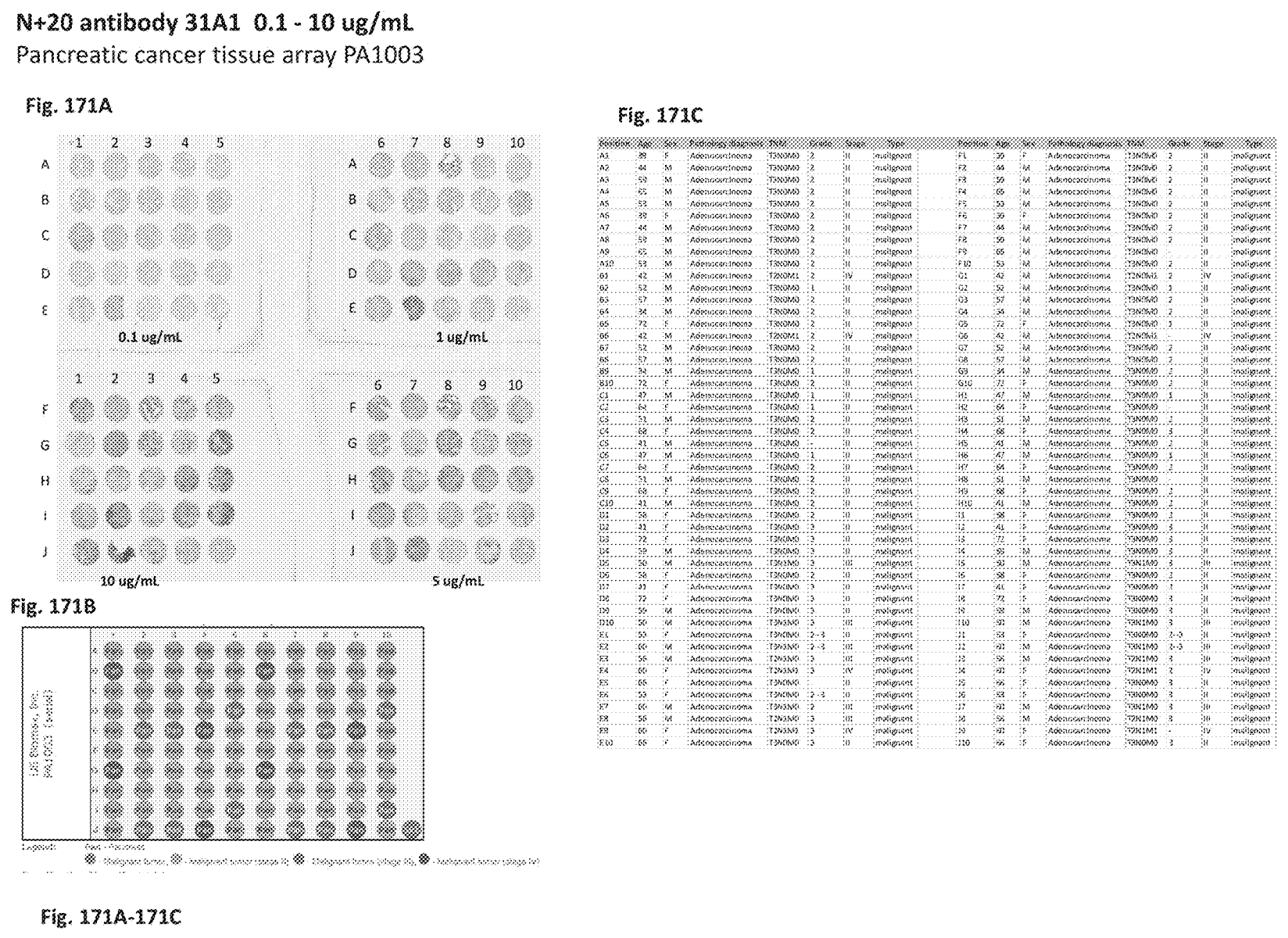

FIG. 171A-171C shows photographs, array map and description of pancreatic cancer tissue array PA1003 stained with the N+20/C-27 antibody 31A1 at 0.5 ug/mL. FIG. 171A shows photographs of the tissue micro array. FIG. 171B shows map of the array with abbreviated tissue descriptors. FIG. 171C detailed description of the tissue micro array with non-identifying donor data.

Figures 172A, 172B, 172C, 172D, 172E, 172F:
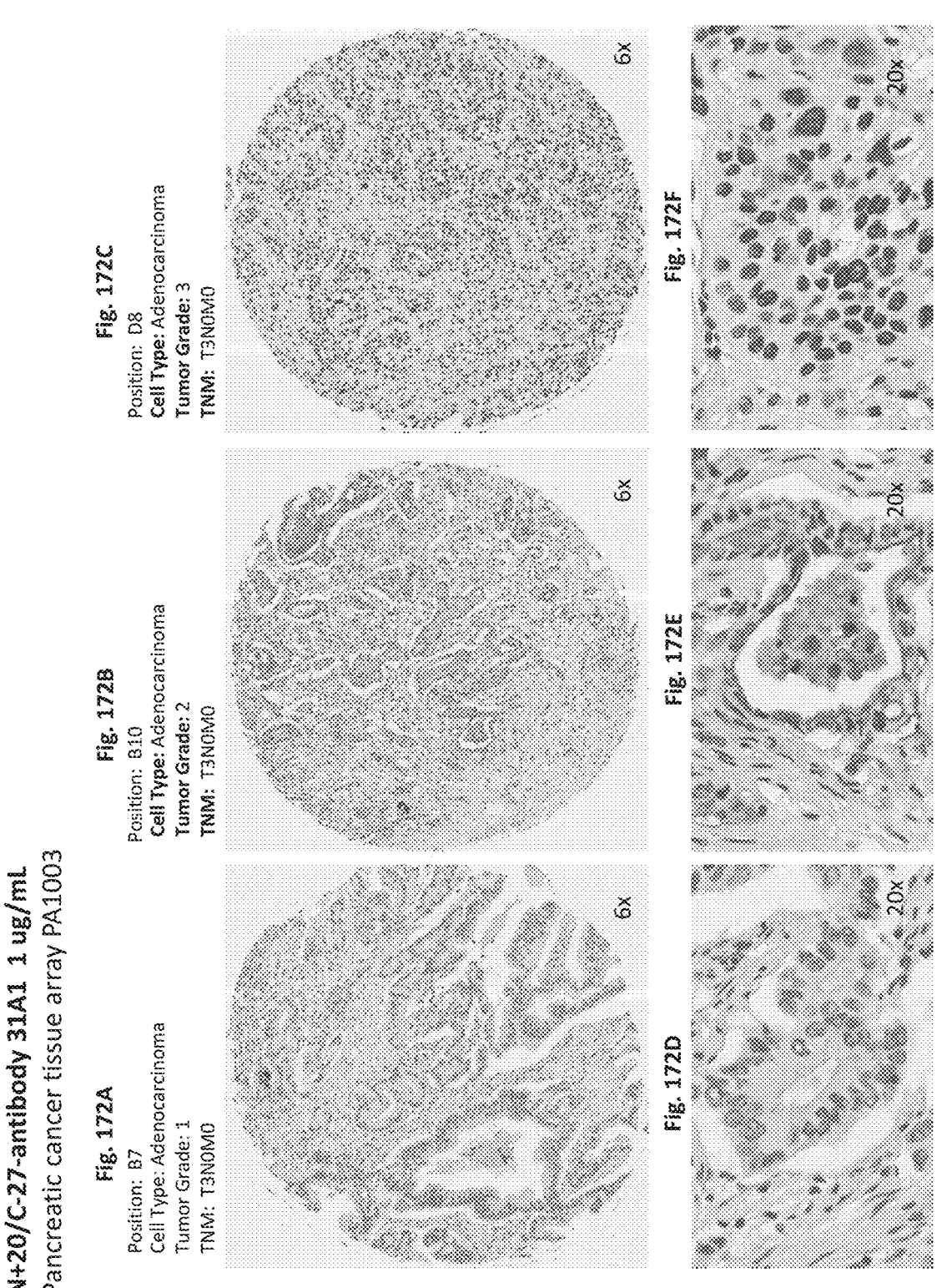

FIG. 172A-172F shows photographs of specific tissues from pancreatic cancer tissue array PA1003 stained with the N+20/C-27 antibody 31A1 at 0.5 ug/mL, magnified to 6× and 20×. FIG. 172A and FIG. 172D are photographs of a Grade 1 adenocarcinoma. FIG. 172B and FIG. 172E are photographs of a Grade 2 adenocarcinoma. FIG. 172C and FIG. 172F are photographs of a Grade 3 adenocarcinoma.

FIG. 173A-173C shows photographs, array map and description of FDA normal tissue array 1021 stained with the N+20/C-27 antibody 32C1 at 0.25 ug/mL. FIG. 173A shows photographs of the tissue micro array. FIG. 173B shows map of the array with abbreviated tissue descriptors. FIG. 173C detailed description of the tissue micro array with non-identifying donor data.

Figures 174I, 174J, 174K, 174L, 174M, 174N, 174O, 174P:
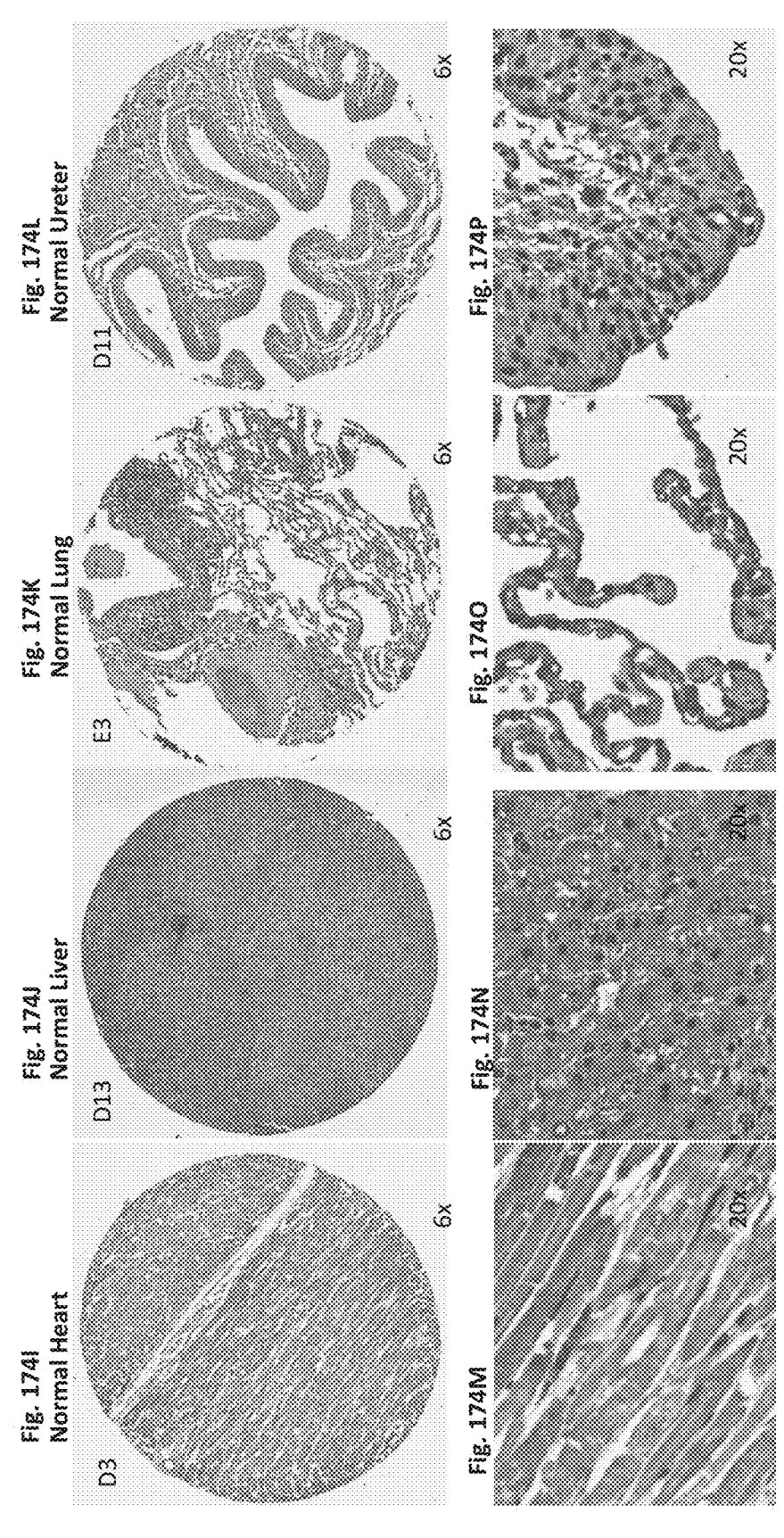

FIG. 174A-174X shows photographs of specific tissues from FDA normal tissue array 1021 stained with the N+20/C-27 antibody 32C1 at 0.25 ug/mL, magnified to 6× and 20×. FIG. 174A and FIG. 174E are adrenal gland. FIG. 174B and FIG. 174F are breast. FIG. 174C and FIG. 174G are fallopian tube. FIG. 174D and FIG. 174H are kidney. FIG. 174I and FIG. 174M are heart muscle. FIG. 174J and FIG. 174N are liver. FIG. 174K and FIG. 174O are lung. FIG. 174L and FIG. 174P are ureter. FIG. 174Q and FIG. 174U are eye. FIG. 174R and FIG. 174V are cerebral cortex. FIG. 174S and FIG. 174W are bone marrow. FIG. 174T and FIG. 174X are skeletal muscle.

Figures 175A, 175B, 175C:
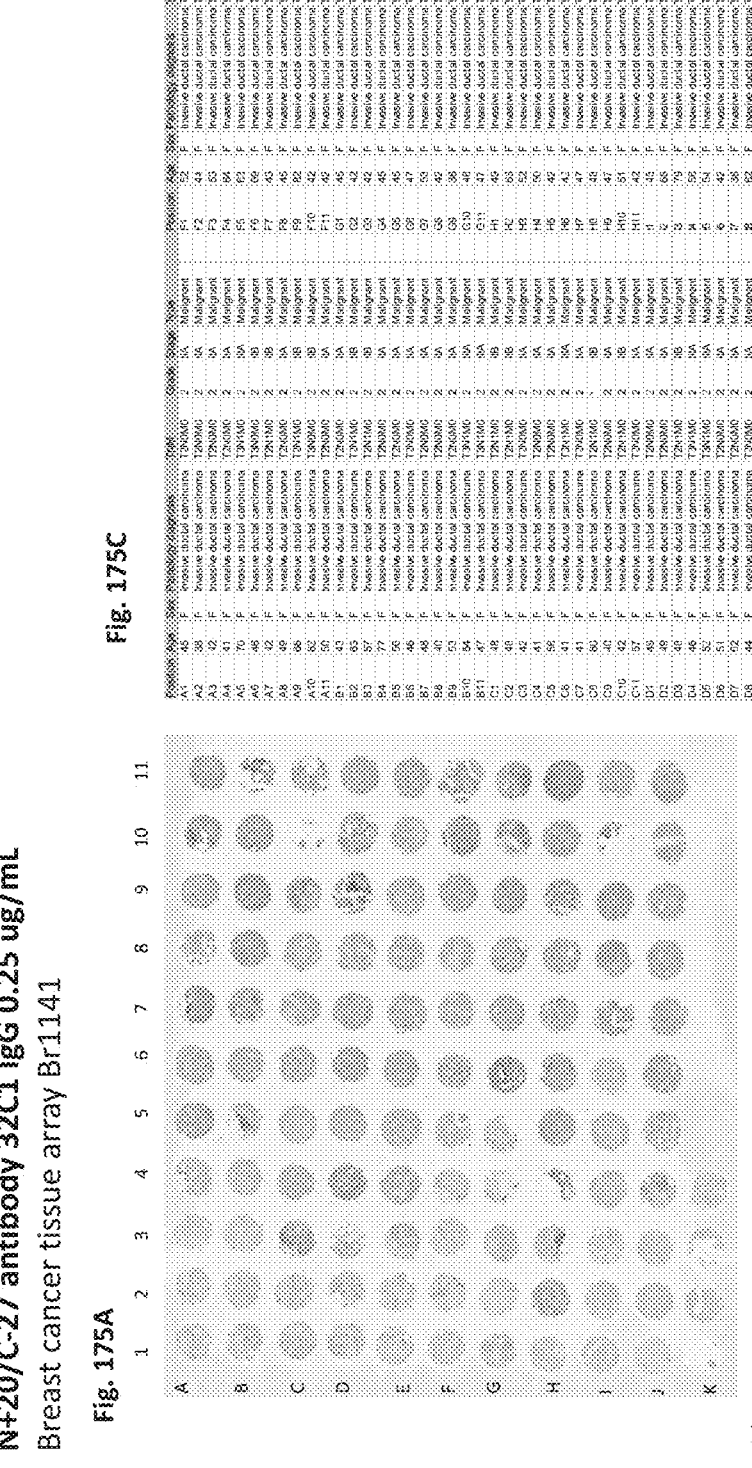

FIG. 175A-175C shows photographs, array map and description of breast cancer tissue array 1141 stained with the N+20/C-27 antibody 32C1 at 5.0 ug/mL. FIG. 175A shows photographs of the tissue micro array. FIG. 175B shows map of the array with abbreviated tissue descriptors. FIG. 175C detailed description of the tissue micro array with non-identifying donor data.

Figures 176A, 176B, 176C, 176D, 176E, 176F:
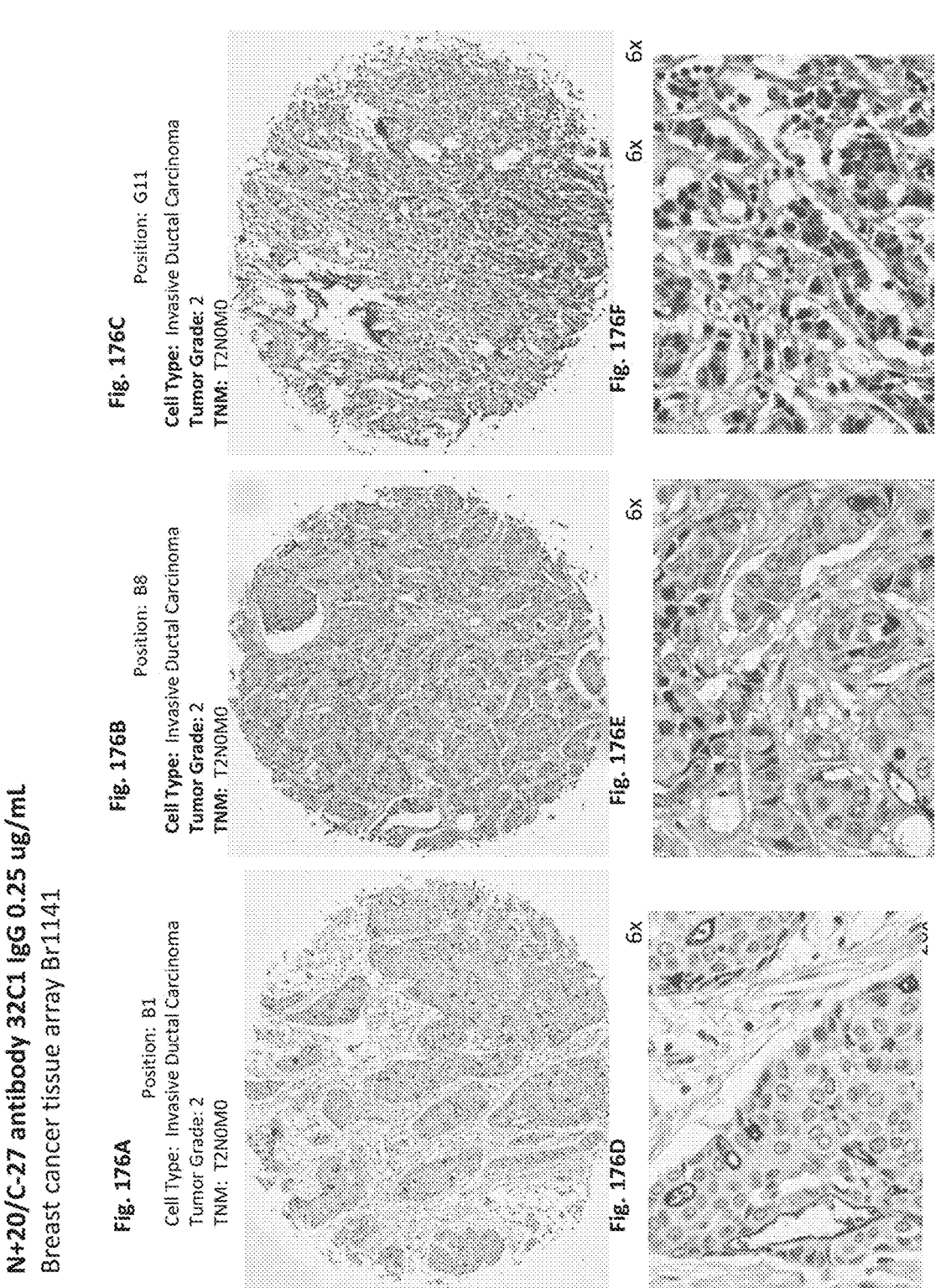

FIG. 176A-176F shows photographs of specific tissues from breast cancer tissue array 1141 stained with the N+20/C-27 antibody 32C1 at 5.0 ug/mL, magnified to 6× and 20×. FIG. 176A and FIG. 176D are photographs of a Grade 2 invasive ductal carcinoma. FIG. 176B and FIG. 176E are photographs of a Grade 2 invasive ductal carcinoma. FIG. 176C and FIG. 176F are photographs of a Grade 2 invasive ductal carcinoma.

FIG. 177A-177C shows photographs, array map and description of esophageal cancer tissue array ES1001 stained with the N+20/C-27 antibody 32C1 at 1.0 ug/mL. FIG. 177A shows photographs of the tissue micro array. FIG. 177B shows map of the array with abbreviated tissue descriptors. FIG. 177C detailed description of the tissue micro array with non-identifying donor data.

Figures 178A, 178B, 178C, 178D, 178E, 178F:
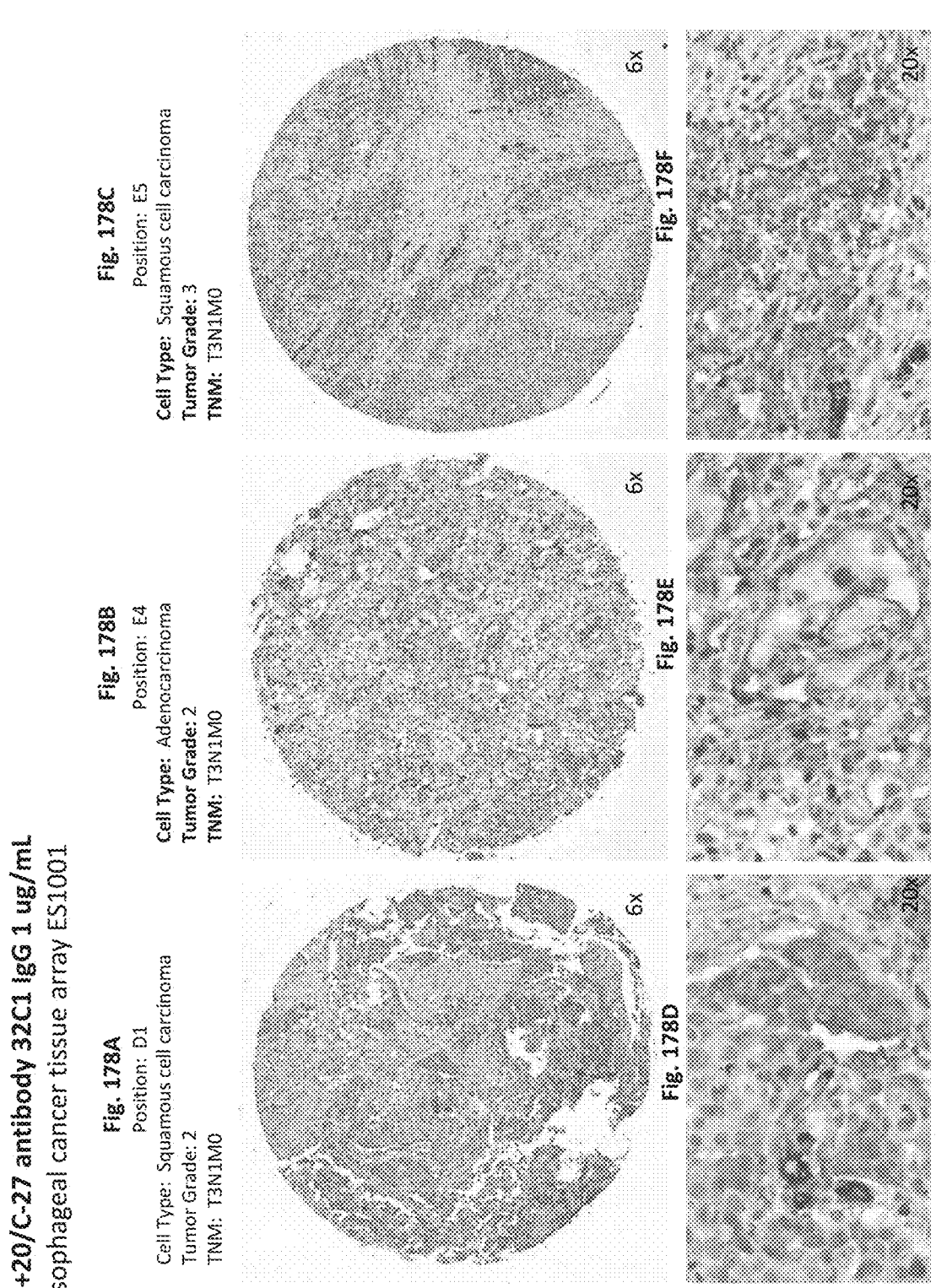

FIG. 178A-178F shows photographs of specific tissues from esophageal cancer tissue array BC001113 stained with the N+20/C-27 antibody 32C1 at 1.0 ug/mL, magnified to 6× and 20×. FIG. 178A and FIG. 178D are photographs of a squamous cell carcinoma. FIG. 178B and FIG. 178E are photographs of an adenocarcinoma. FIG. 178C and FIG. 178F are photographs of a squamous cell carcinoma.

FIG. 179A-179C shows photographs, array map and description of FDA normal tissue array 1021 stained with the N+20/C-27 antibody 45C11 at 12.5 ug/mL. FIG. 179A shows photographs of the tissue micro array. FIG. 179B shows map of the array with abbreviated tissue descriptors. FIG. 179C detailed description of the tissue micro array with non-identifying donor data.

Figures 180Q, 180R, 180S, 180T, 180U, 180V, 180W, 180X:
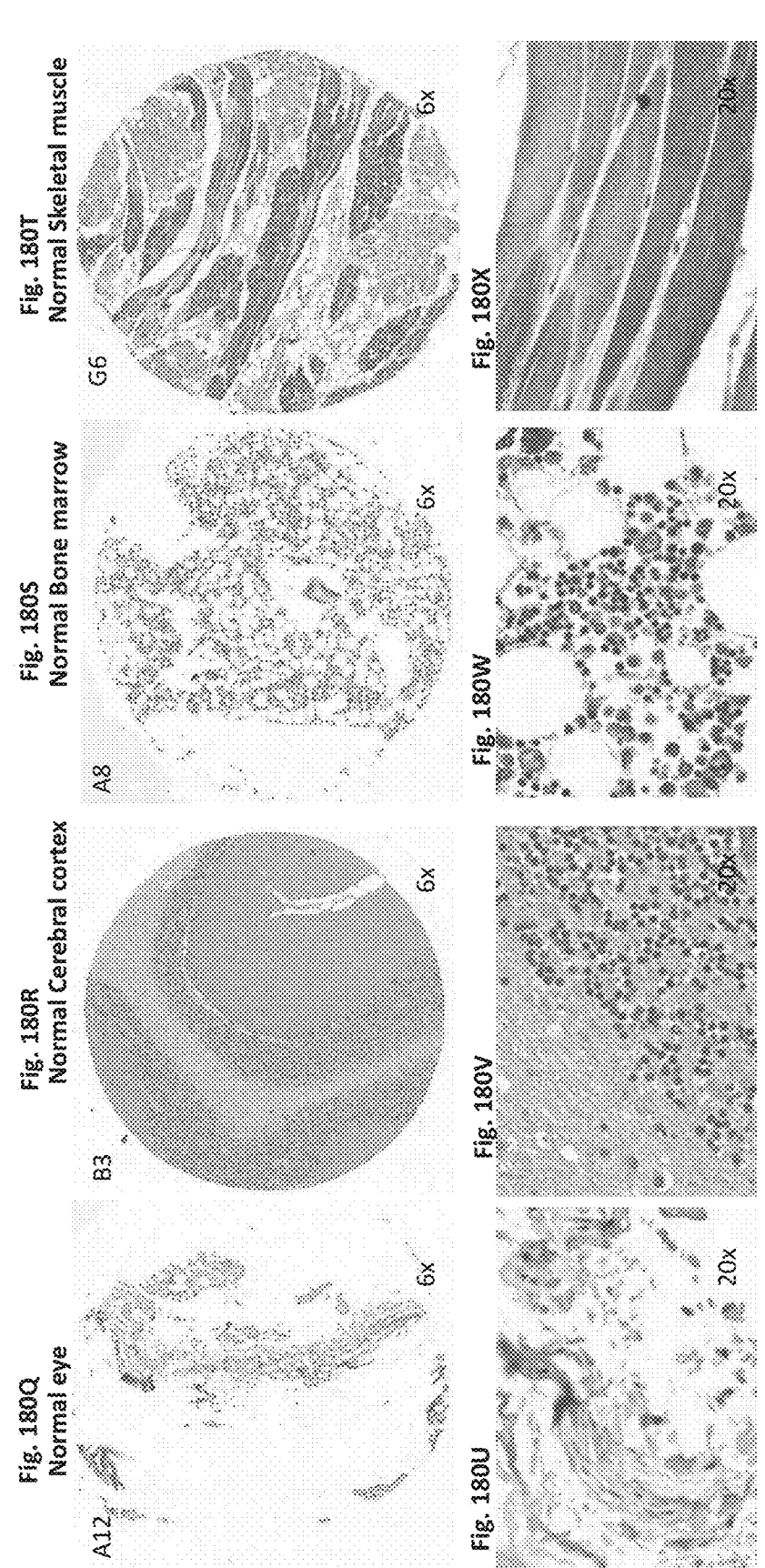

FIG. 180A-180X shows photographs of specific tissues from FDA normal tissue array 1021 stained with the N+20/C-27 antibody 45C11 at 12.5 ug/mL, magnified to 6× and 20×. FIG. 180A and FIG. 180E are adrenal gland. FIG. 180B and FIG. 180F are breast. FIG. 180C and FIG. 180G are fallopian tube. FIG. 180D and FIG. 180H are kidney. FIG. 180I and FIG. 180M are heart muscle. FIG. 180J and FIG. 180N are liver. FIG. 180K and FIG. 180O are lung. FIG. 180L and FIG. 180P are ureter. FIG. 180Q and FIG. 180U are eye. FIG. 180R and FIG. 180V are cerebral cortex. FIG. 180S and FIG. 180W are bone marrow. FIG. 180T and FIG. 180X are skeletal muscle.

Figures 181A, 181B, 181C:
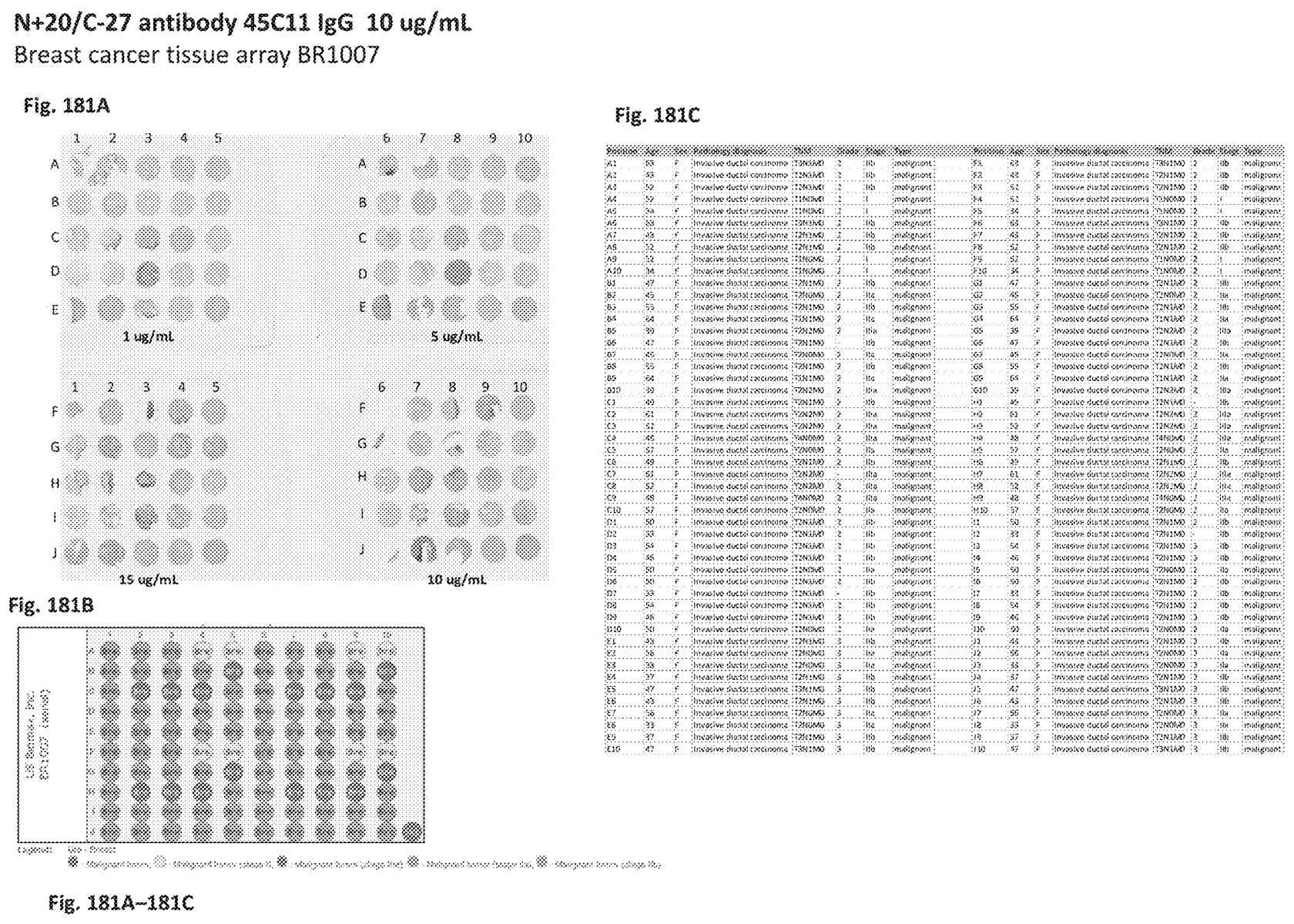

FIG. 181A-181C shows photographs, array map and description of breast cancer tissue array BR1007 stained with the N+20/C-27 antibody 45C11 at 10.0 ug/mL. FIG. 181A shows photographs of the tissue micro array. FIG. 181B shows map of the array with abbreviated tissue descriptors. FIG. 181C detailed description of the tissue micro array with non-identifying donor data.

Figures 182A, 182B, 182C, 182D, 182E, 182F:
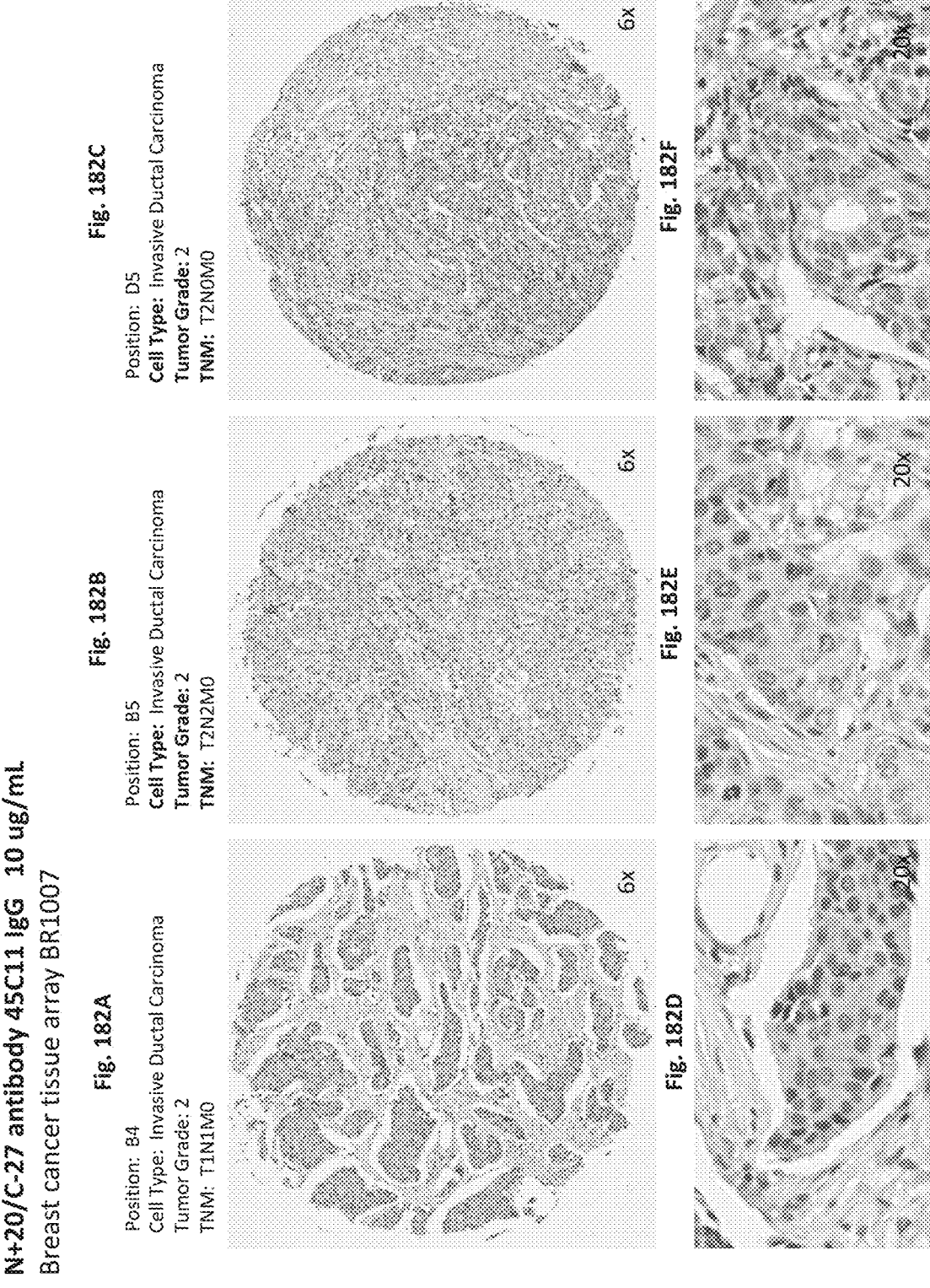

FIG. 182A-182F shows photographs of specific tissues from breast cancer tissue array BR1007 stained with the N+20/C-27 antibody 45C11 at 10.0 ug/mL, magnified to 6× and 20×. FIG. 182A and FIG. 182D are photographs of a Grade 2 invasive ductal carcinoma with positive lymph nodes. FIG. 182B and FIG. 182E are photographs of a Grade 2 invasive ductal carcinoma. FIG. 182C and FIG. 182F are photographs of a Grade 2 invasive ductal carcinoma.

Figures 183A, 183B, 183C:
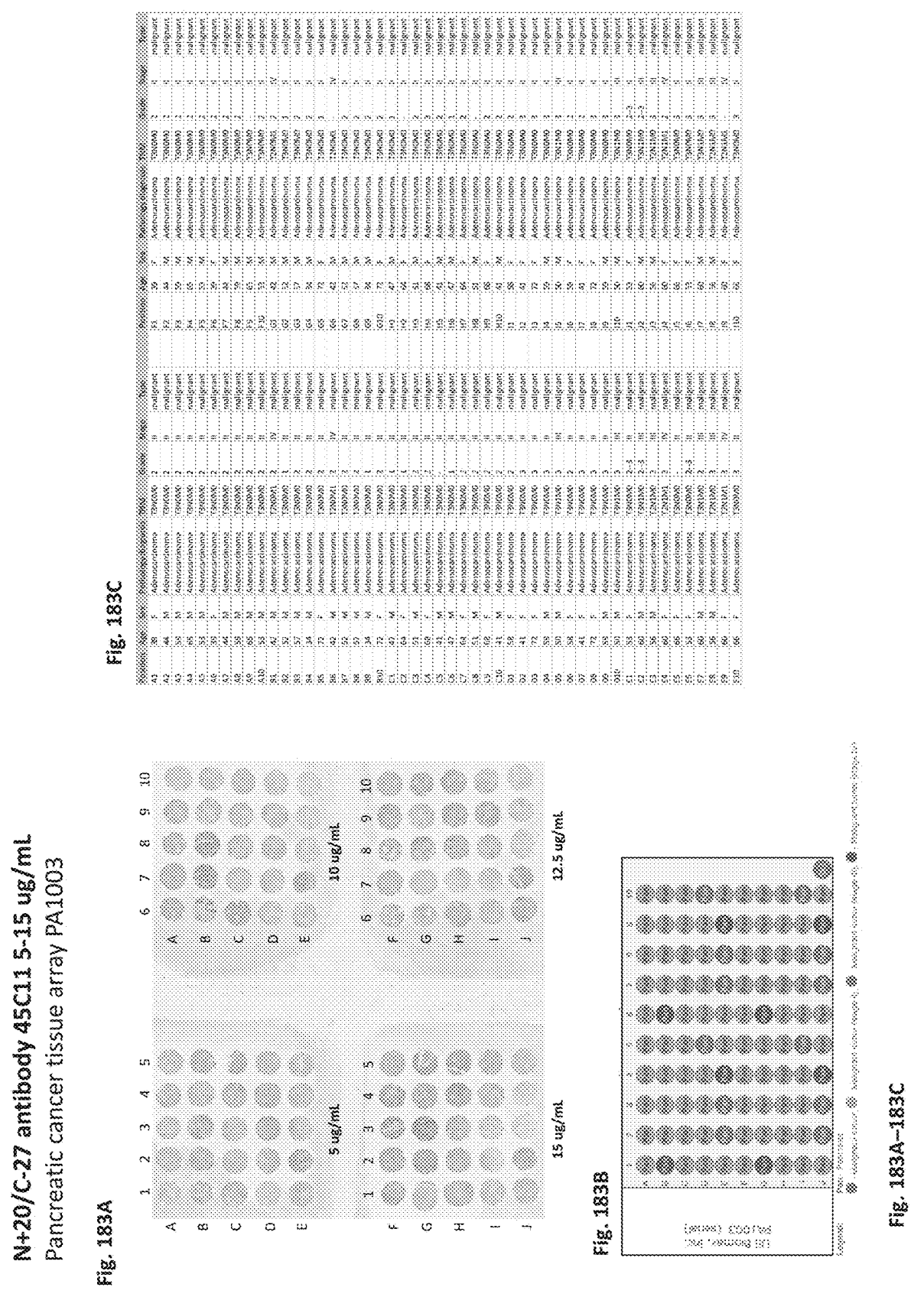

FIG. 183A-183C shows photographs, array map and description of pancreatic cancer tissue array PA805c stained with the N+20/C-27 antibody 45C11 at 12.5 ug/mL. FIG. 183A shows photographs of the tissue micro array. FIG. 183B shows map of the array with abbreviated tissue descriptors. FIG. 183C detailed description of the tissue micro array with non-identifying donor data.

Figures 184A, 184B, 184C, 184D, 184E, 184F:
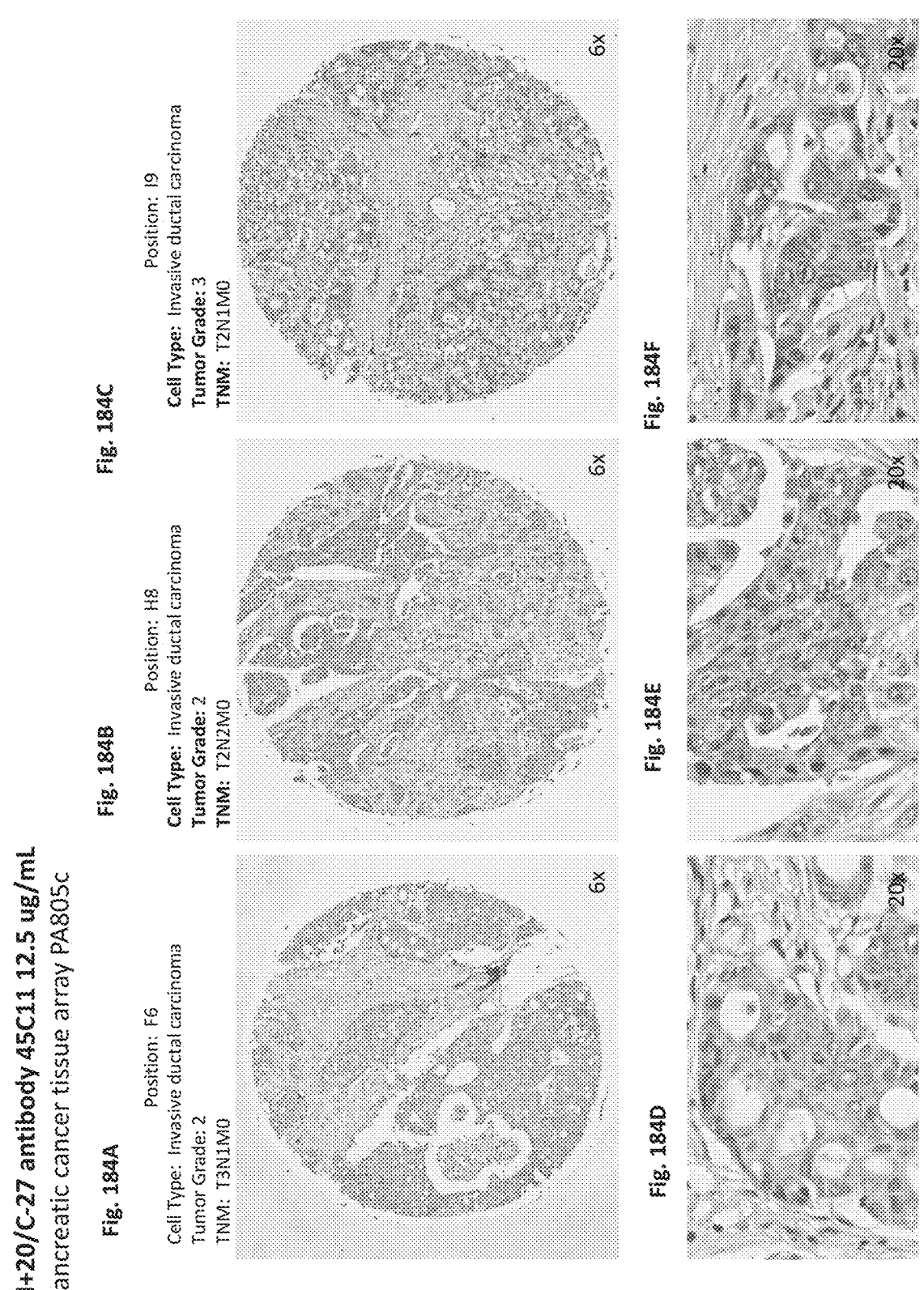

FIG. 184A-184F shows photographs of specific tissues from pancreatic cancer tissue array PA805c stained with the N+20/C-27 antibody 45C11 at 12.5 ug/mL, magnified to 6× and 20×. FIG. 184A and FIG. 184D are photographs of a Grade 2 papillary adenocarcinoma. FIG. 184B and FIG. 184E are photographs of a Grade 2-3 ductal carcinoma. FIG. 184C and FIG. 184F are photographs of a Grade 3 invasive adenocarcinoma.

FIG. 185A-185C shows photographs, array map and description of FDA normal tissue array 1021 stained with the N+9/C-9 antibody 3C5 at 10.0 ug/mL. FIG. 185A shows photographs of the tissue micro array. FIG. 185B shows map of the array with abbreviated tissue descriptors. FIG. 185C detailed description of the tissue micro array with non-identifying donor data.

Figures 186I, 186J, 186K, 186L, 186M, 186N, 186O, 186P:
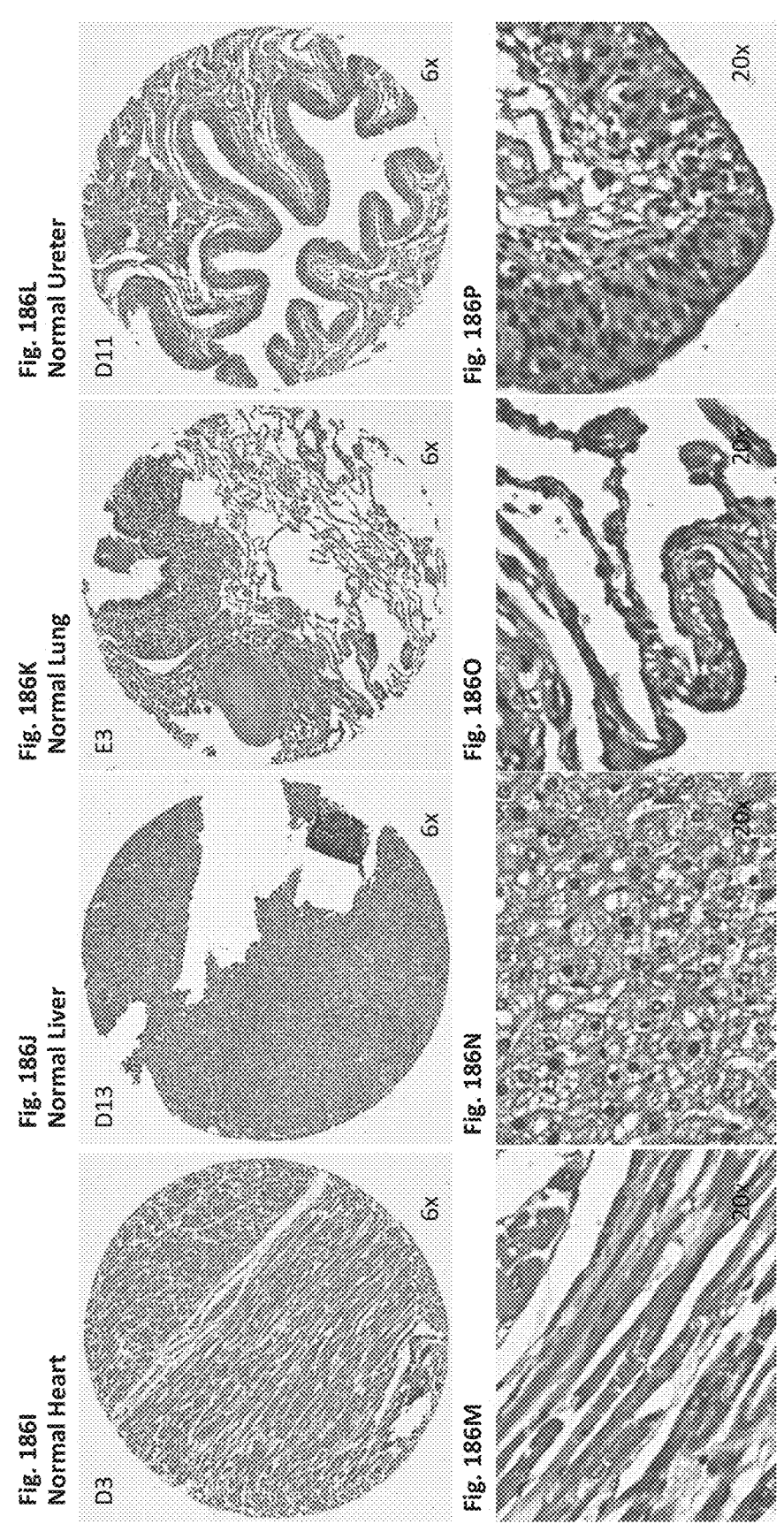
Figures 186Q, 186R, 186S, 186T, 186U, 186V, 186W, 186X:
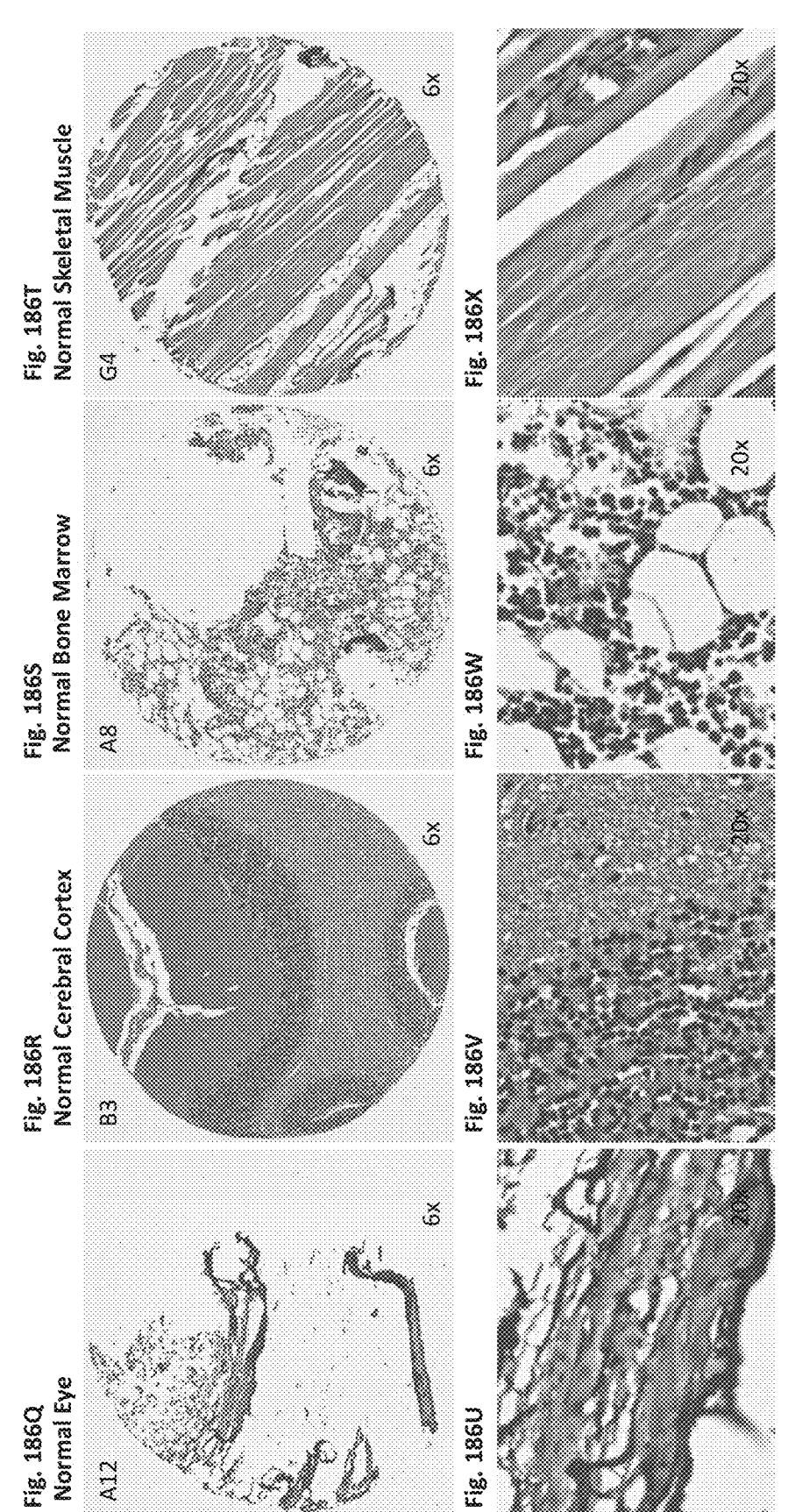

FIG. 186A-186X shows photographs of specific tissues from FDA normal tissue array 1021 stained with the N+9/C-9 antibody 3C5 at 10.0 ug/mL, magnified to 6× and 20×. FIG. 186A and FIG. 186E are adrenal gland. FIG. 186B and FIG. 186F are breast. FIG. 186C and FIG. 186G are fallopian tube. FIG. 186D and FIG. 186H are kidney. FIG. 186I and FIG. 186M are heart muscle. FIG. 186J and FIG. 186N are liver. FIG. 186K and FIG. 186O are lung. FIG. 186L and FIG. 186P are ureter. FIG. 186Q and FIG. 186U are eye. FIG. 186R and FIG. 186V are cerebral cortex. FIG. 186S and FIG. 186W are bone marrow. FIG. 186T and FIG. 186X are skeletal muscle.

Figures 187A, 187B, 187C:
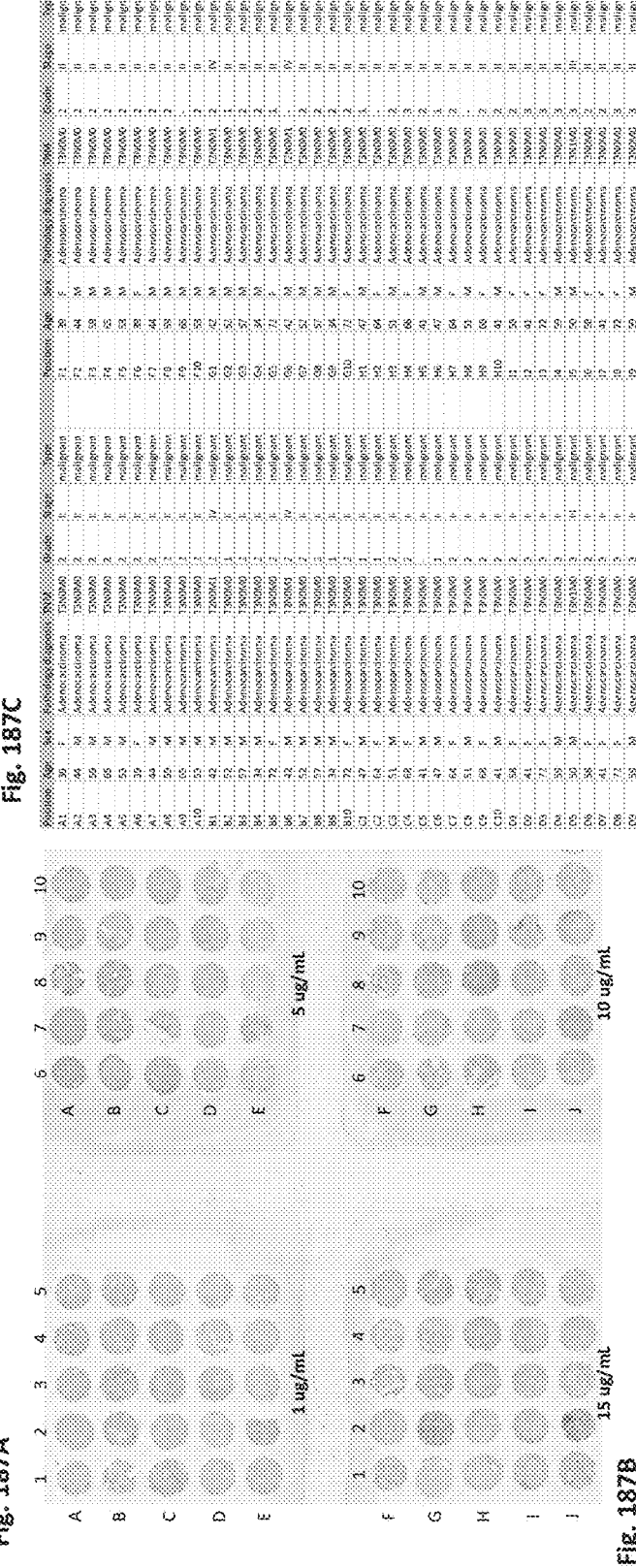

FIG. 187A-187C shows photographs, array map and description of pancreatic cancer tissue array PA1003 stained with the N+9/C-9 antibody 3C5 at 10.0 ug/mL. FIG. 187A shows photographs of the tissue micro array. FIG. 187B shows map of the array with abbreviated tissue descriptors. FIG. 187C detailed description of the tissue micro array with non-identifying donor data.

Figures 188A, 188B, 188C, 188D, 188E, 188F:
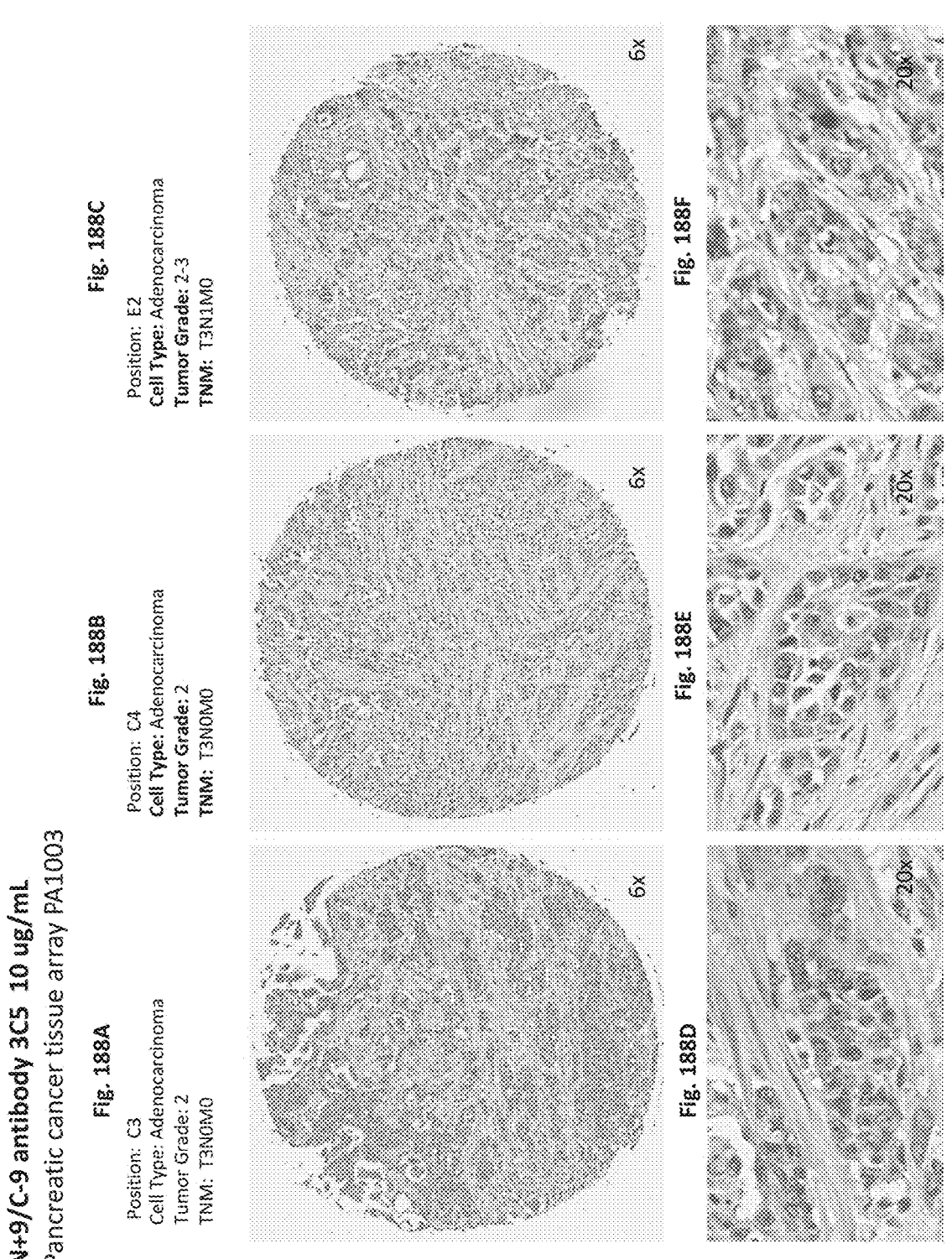

FIG. 188A-188F shows photographs of specific tissues from pancreatic cancer tissue array PA1003 stained with the N+9/C-9 antibody 3C5 at 10.0 ug/mL, magnified to 6× and 20×. FIG. 188A and FIG. 188D are photographs of a Grade 2 adenocarcinoma. FIG. 188B and FIG. 188E are photographs of a Grade 2 adenocarcinoma. FIG. 188C and FIG. 188F are photographs of a Grade 2-3 adenocarcinoma with lymph node involvement.

FIG. 189A-189C shows photographs, array map and description of FDA normal tissue array 1021 stained with the N+9/C-9 antibody 8A9 at 15.0 ug/mL. FIG. 189A shows photographs of the tissue micro array. FIG. 189B shows map of the array with abbreviated tissue descriptors. FIG. 189C detailed description of the tissue micro array with non-identifying donor data.

Figures 190I, 190J, 190K, 190L, 190M, 190N, 190O, 190P:
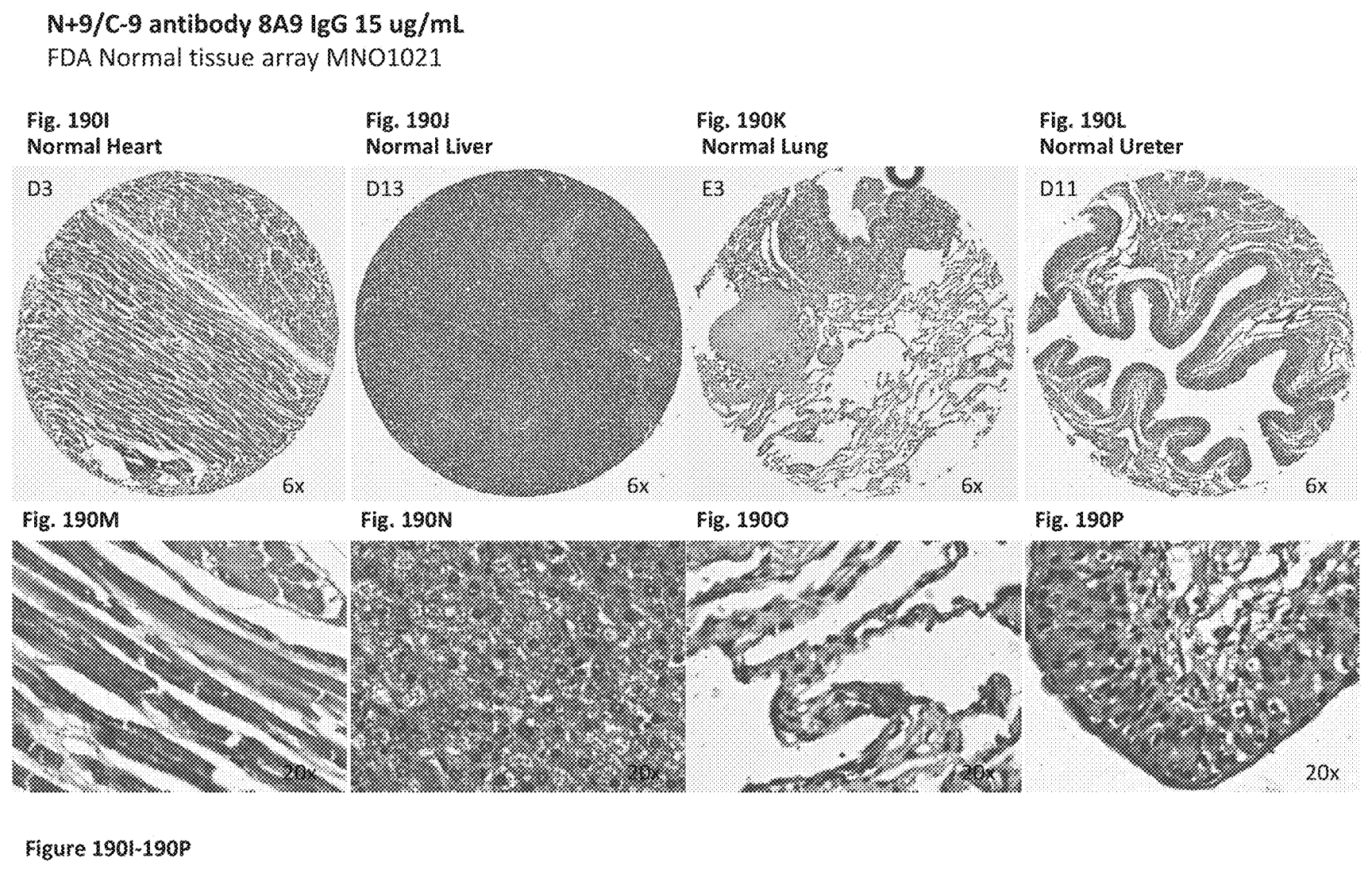

FIG. 190A-190X shows photographs of specific tissues from FDA normal tissue array 1021 stained with the N+9/C-9 antibody 8A9 at 15.0 ug/mL, magnified to 6× and 20×. FIG. 190A and FIG. 190E are adrenal gland. FIG. 190B and FIG. 190F are breast. FIG. 190C and FIG. 190G are fallopian tube. FIG. 190D and FIG. 190H are kidney. FIG. 190I and FIG. 190M are heart muscle. FIG. 190J and FIG. 190N are liver. FIG. 190K and FIG. 190O are lung. FIG. 190L and FIG. 190P are ureter. FIG. 190Q and FIG. 190U are eye. FIG. 190R and FIG. 190V are cerebral cortex. FIG. 190S and FIG. 190W are bone marrow. FIG. 190T and FIG. 190X are skeletal muscle.

Figures 191A, 191B, 191C:
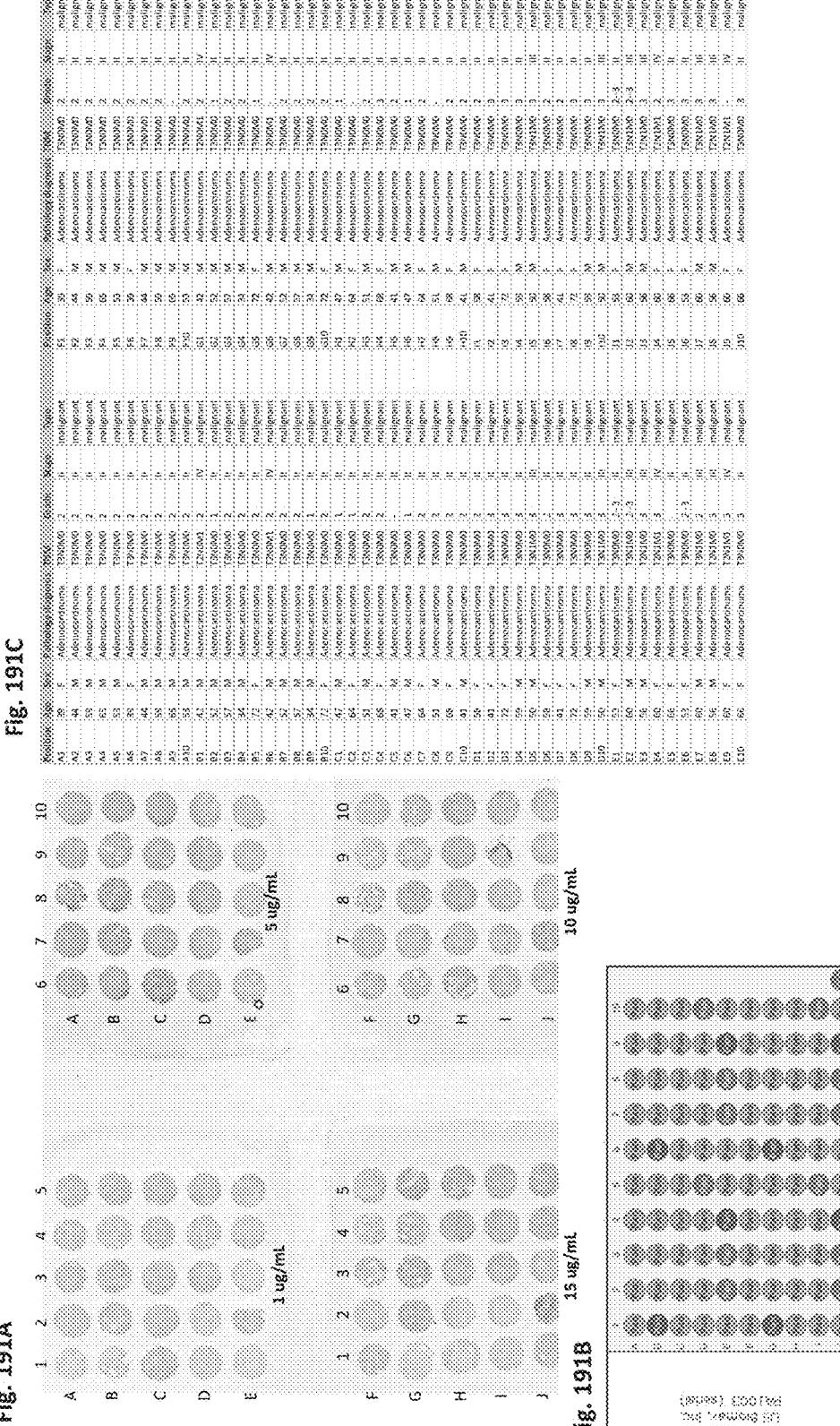

FIG. 191A-191C shows photographs, array map and description of pancreatic cancer tissue array PA1003 stained with the N+9/C-9 antibody 8A9 at 15.0 ug/mL. FIG. 191A shows photographs of the tissue micro array. FIG. 191B shows map of the array with abbreviated tissue descriptors. FIG. 191C detailed description of the tissue micro array with non-identifying donor data.

Figures 192A, 192B, 192C, 192D, 192E, 192F:
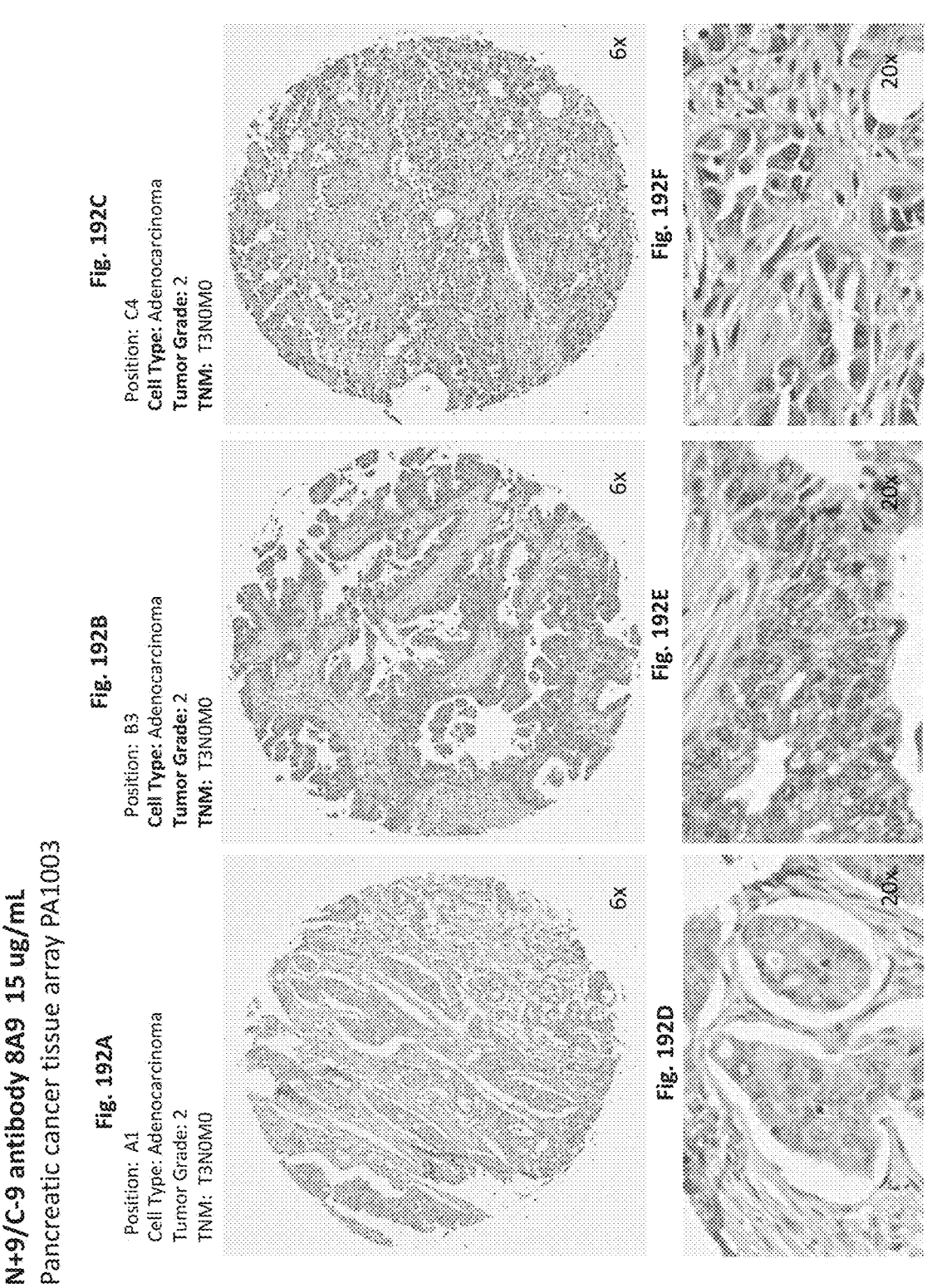

FIG. 192A-192F shows photographs of specific tissues from pancreatic cancer tissue array PA1003 stained with the N+9/C-9 antibody 8A9 at 15.0 ug/mL, magnified to 6× and 20×. FIG. 192A and FIG. 192D are photographs of a Grade 2 adenocarcinoma. FIG. 192B and FIG. 192E are photographs of a Grade 2 adenocarcinoma. FIG. 192C and FIG. 192F are photographs of a Grade 2 adenocarcinoma.

FIG. 193A-193C shows photographs, array map and description of FDA normal tissue array 1021 stained with the N+9/C-9 antibody 17H6 at 30.0 ug/mL. FIG. 193A shows photographs of the tissue micro array. FIG. 193B shows map of the array with abbreviated tissue descriptors. FIG. 193C detailed description of the tissue micro array with non-identifying donor data.

Figures 194A, 194B, 194C, 194D, 194E, 194F, 194G, 194H:
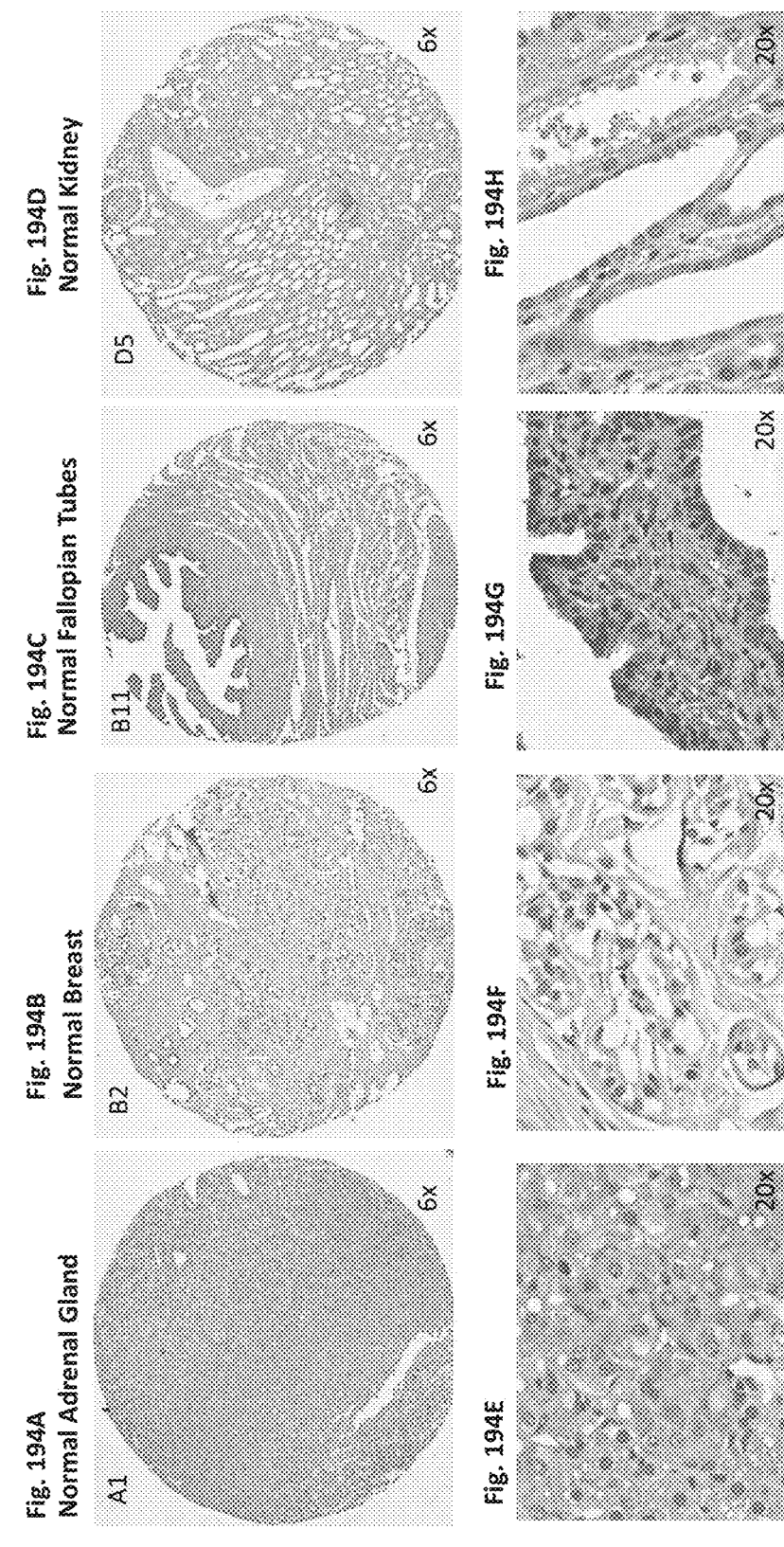
Figures 194I, 194J, 194K, 194L, 194M, 194N, 194O, 194P:
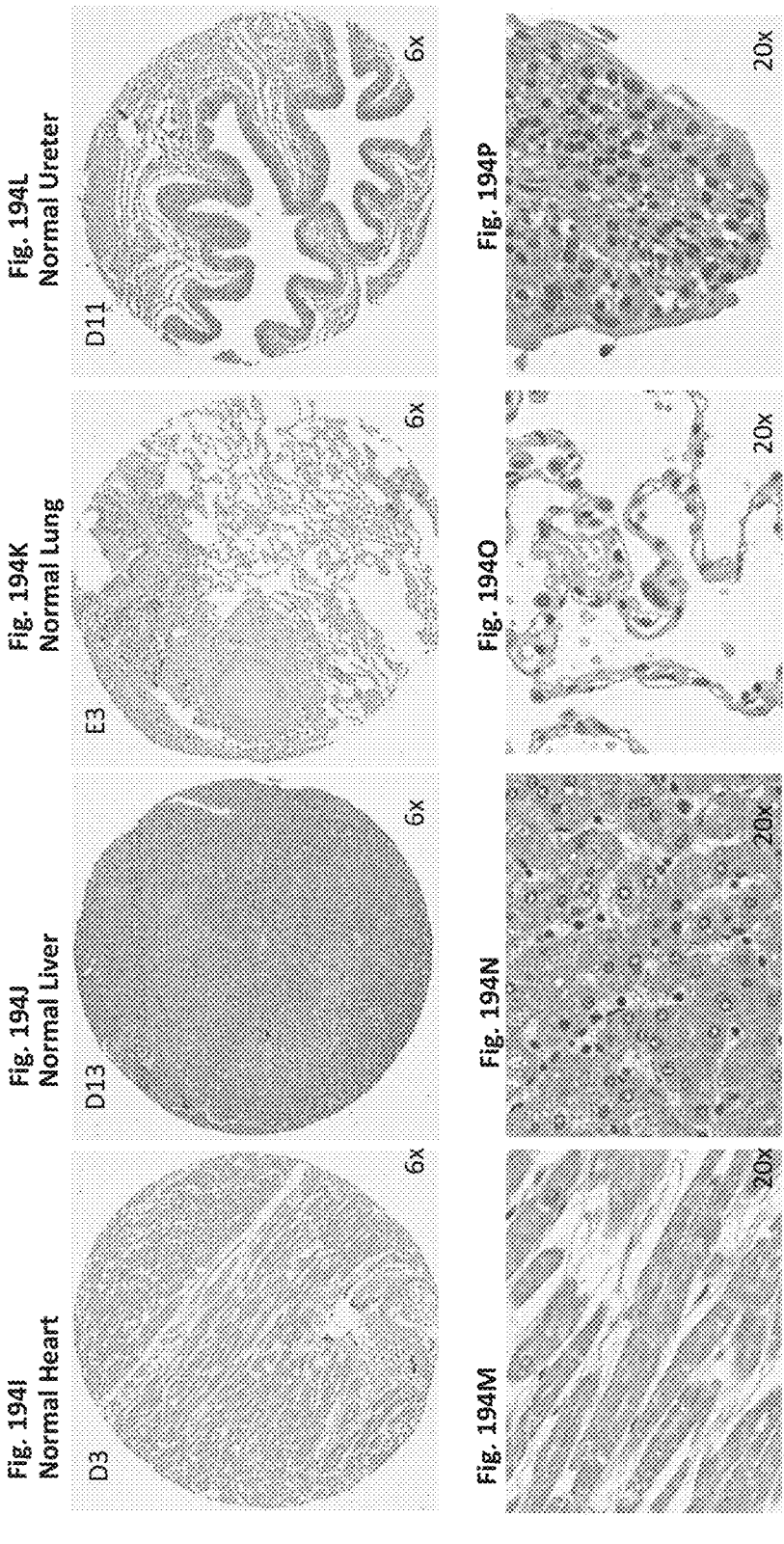

FIG. 194A-194X shows photographs of specific tissues from FDA normal tissue array 1021 stained with the N+9/C-9 antibody 17H6 at 30.0 ug/mL, magnified to 6× and 20×. FIG. 194A and FIG. 194E are adrenal gland. FIG. 194B and FIG. 194F are breast. FIG. 194C and FIG. 194G are fallopian tube. FIG. 194D and FIG. 194H are kidney. FIG. 194I and FIG. 194M are heart muscle. FIG. 194J and FIG. 194N are liver. FIG. 194K and FIG. 194O are lung. FIG. 194L and FIG. 194P are ureter. FIG. 194Q and FIG. 194U are eye. FIG. 194R and FIG. 194V are cerebral cortex. FIG. 194S and FIG. 194W are bone marrow. FIG. 194T and FIG. 194X are skeletal muscle.

Figures 195A, 195B, 195C:
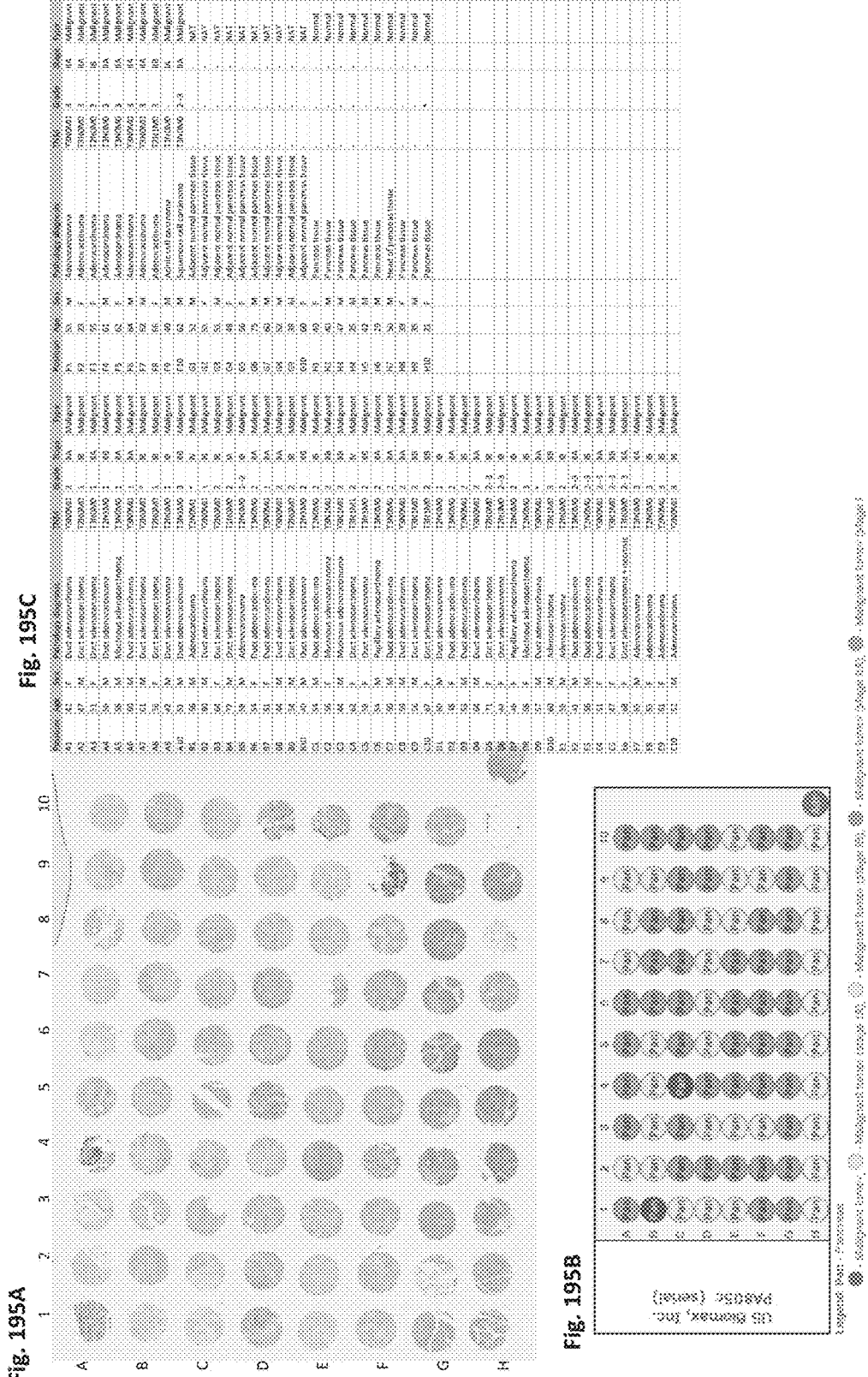

FIG. 195A-195C shows photographs, array map and description of pancreatic cancer tissue array PA805c stained with the N+9/C-9 antibody 17H6 at 30.0 ug/mL. FIG. 195A shows photographs of the tissue micro array. FIG. 195B shows map of the array with abbreviated tissue descriptors. FIG. 195C detailed description of the tissue micro array with non-identifying donor data.

Figures 196A, 196B, 196C, 196D, 196E, 196F:
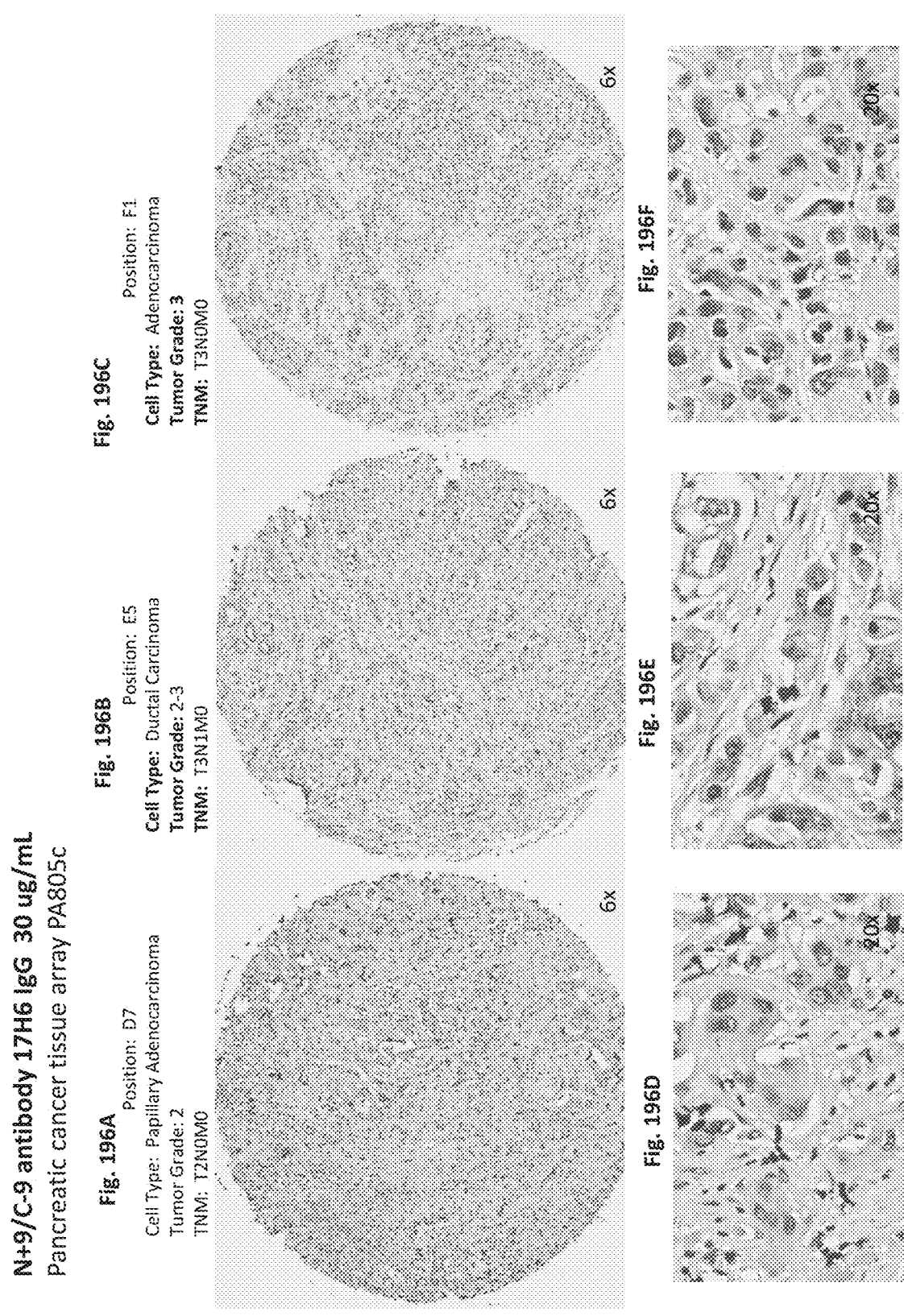

FIG. 196A-196F shows photographs of specific tissues from pancreatic cancer tissue array PA805c stained with the N+9/C-9 antibody 17H6 at 30.0 ug/mL, magnified to 6× and 20×. FIG. 196A and FIG. 196D are photographs of a Grade 2 papillary adenocarcinoma. FIG. 196B and FIG. 196E are photographs of a Grade 2-3 ductal carcinoma with lymph node involvement. FIG. 196C and FIG. 196F are photographs of a Grade 3 invasive adenocarcinoma.

Figures 197A, 197B, 197C:
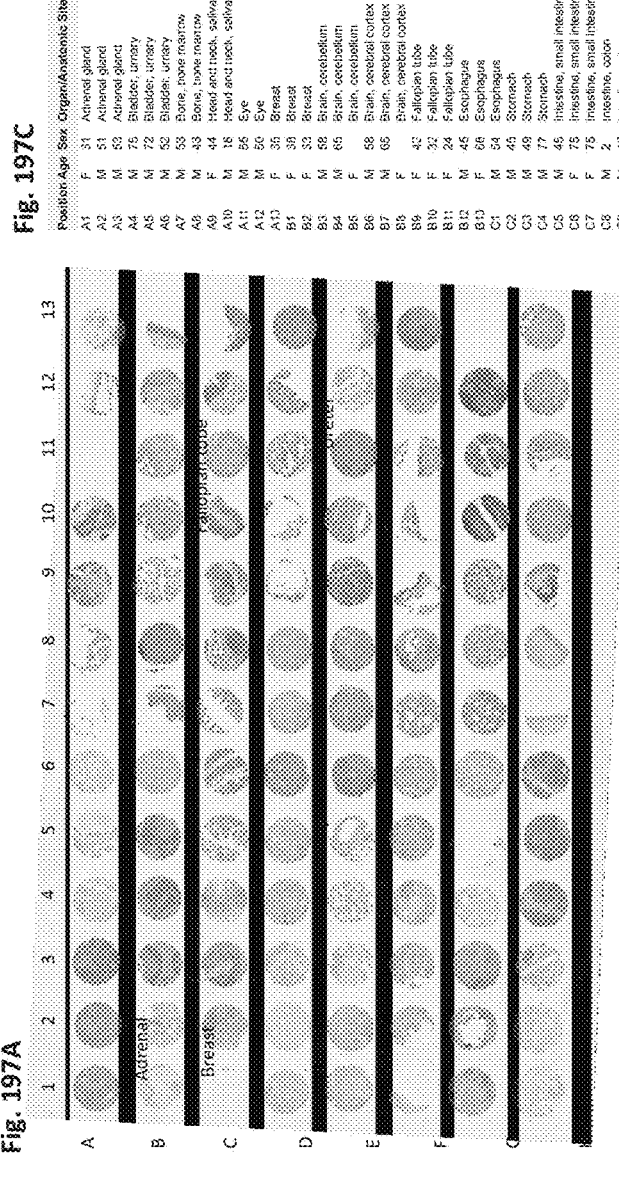

FIG. 197A-197C shows photographs, array map and description of FDA normal tissue array 1021 stained with the N+9/C-9 antibody 39H5 at 5.0 ug/mL. FIG. 197A shows photographs of the tissue micro array. FIG. 197B shows map of the array with abbreviated tissue descriptors. FIG. 197C detailed description of the tissue micro array with non-identifying donor data.

Figures 198I, 198J, 198K, 198L, 198M, 198N, 198O, 198P:
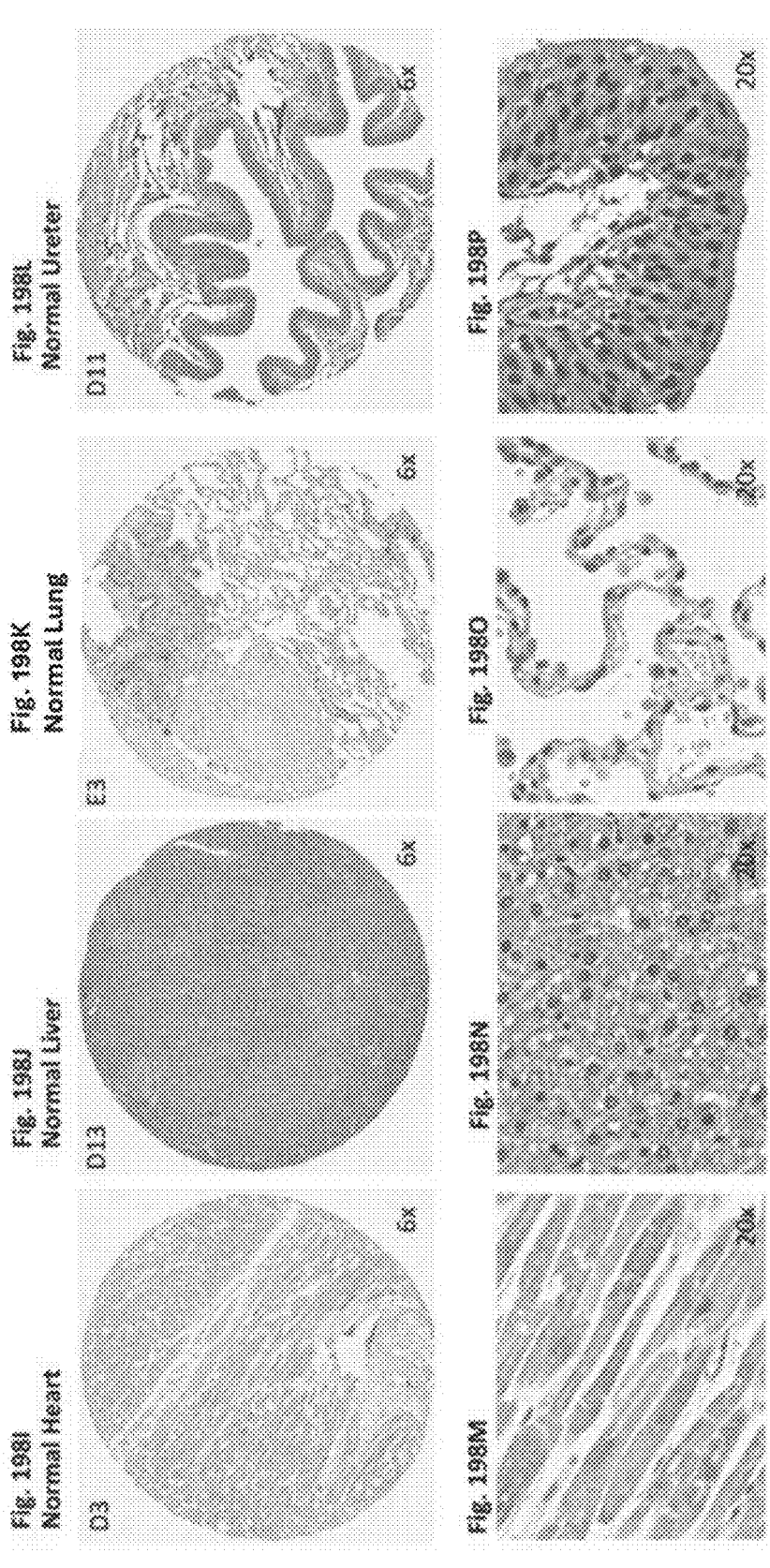
Figures 198Q, 198R, 198S, 198T, 198U, 198V, 198W, 198X:
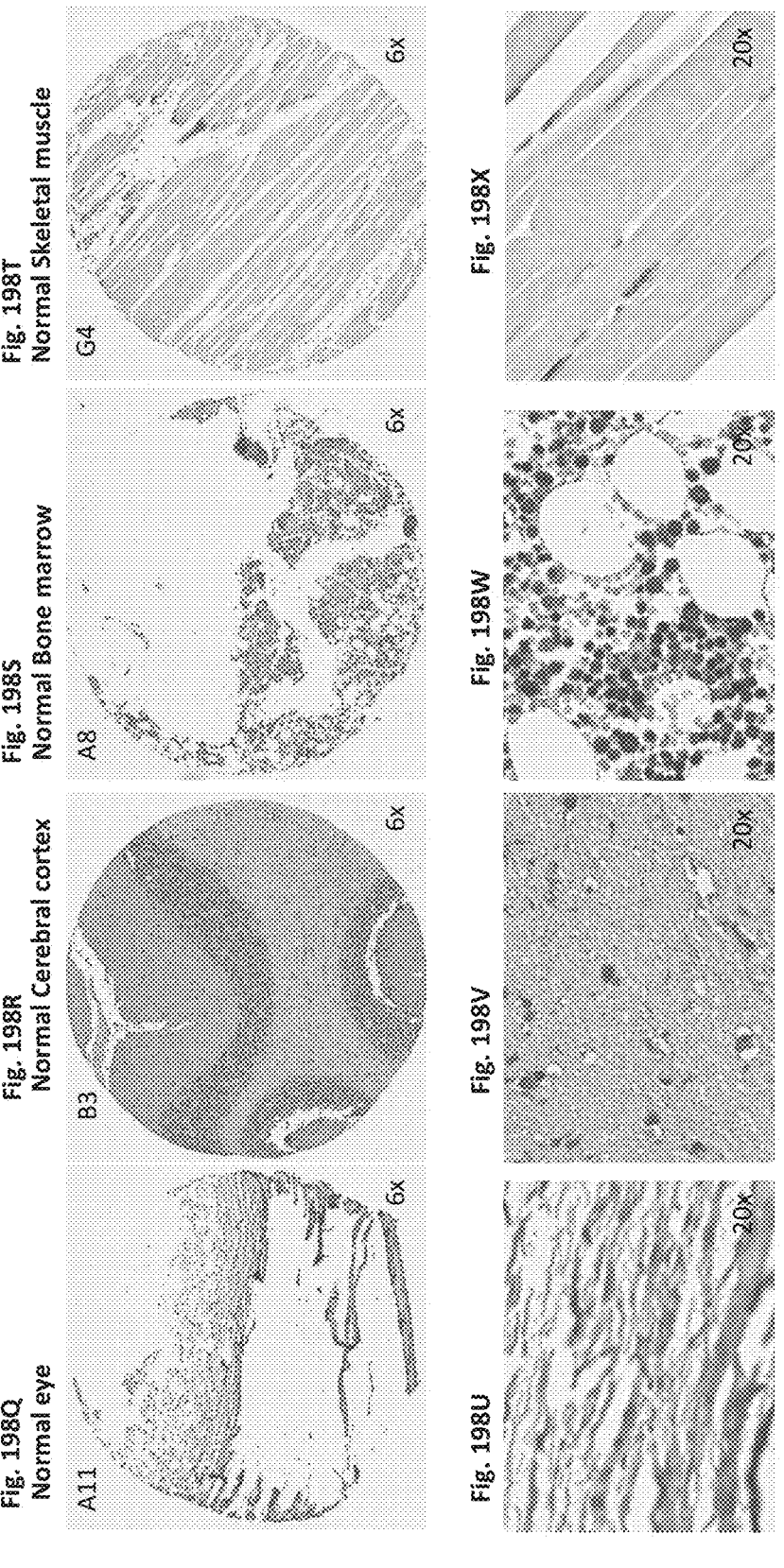

FIG. 198A-198X shows photographs of specific tissues from FDA normal tissue array 1021 stained with the N+9/C-9 antibody 39H5 at 5.0 ug/mL, magnified to 6× and 20×. FIG. 198A and FIG. 198E are adrenal gland. FIG. 198B and FIG. 198F are breast. FIG. 198C and FIG. 198G are fallopian tube. FIG. 198D and FIG. 198H are kidney. FIG. 198I and FIG. 198M are heart muscle. FIG. 198J and FIG. 198N are liver. FIG. 198K and FIG. 198O are lung. FIG. 198L and FIG. 198P are ureter. FIG. 198Q and FIG. 198U are eye. FIG. 198R and FIG. 198V are cerebral cortex. FIG. 198S and FIG. 198W are bone marrow. FIG. 198T and FIG. 198X are skeletal muscle.

Figures 199A, 199B, 199C:

FIG. 199A-199C shows photographs, array map and description of pancreatic cancer tissue array PA1003 stained with the N+9/C-9 antibody 39H5 at 5.0 ug/mL. FIG. 199A shows photographs of the tissue micro array. FIG. 199B shows map of the array with abbreviated tissue descriptors. FIG. 199C detailed description of the tissue micro array with non-identifying donor data.

Figures 200A, 200B, 200C, 200D, 200E, 200F:
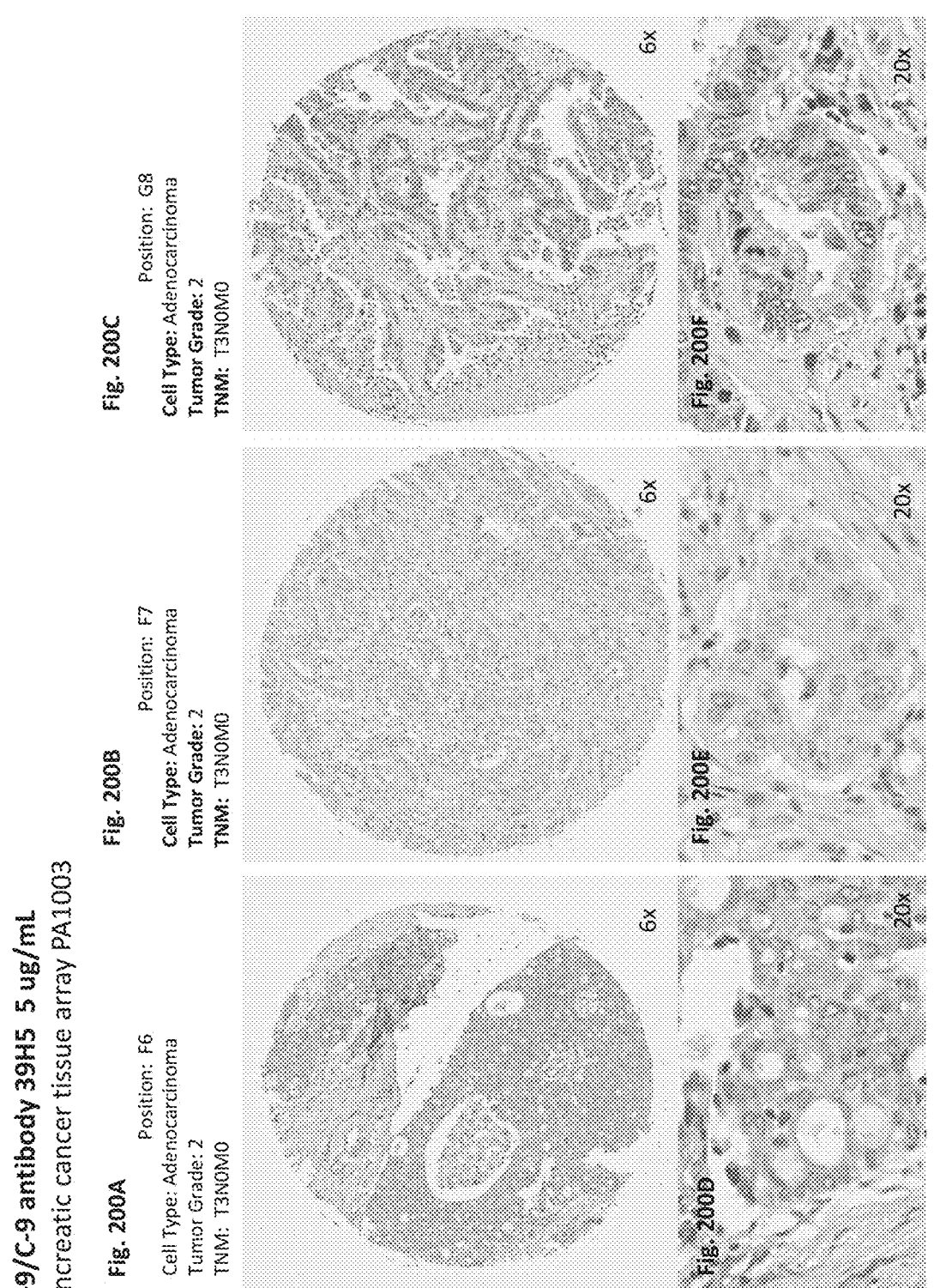

FIG. 200A-200F shows photographs of specific tissues from pancreatic cancer tissue array PA1003 stained with the N+9/C-9 antibody 39H5 at 5.0 ug/mL, magnified to 6× and 20×. FIG. 200A and FIG. 200D are photographs of a Grade 2 adenocarcinoma. FIG. 200B and FIG. 200E are photographs of a Grade 2 adenocarcinoma. FIG. 200C and FIG. 200F are photographs of a Grade 2 adenocarcinoma.

Figures 201A, 201B, 201C:
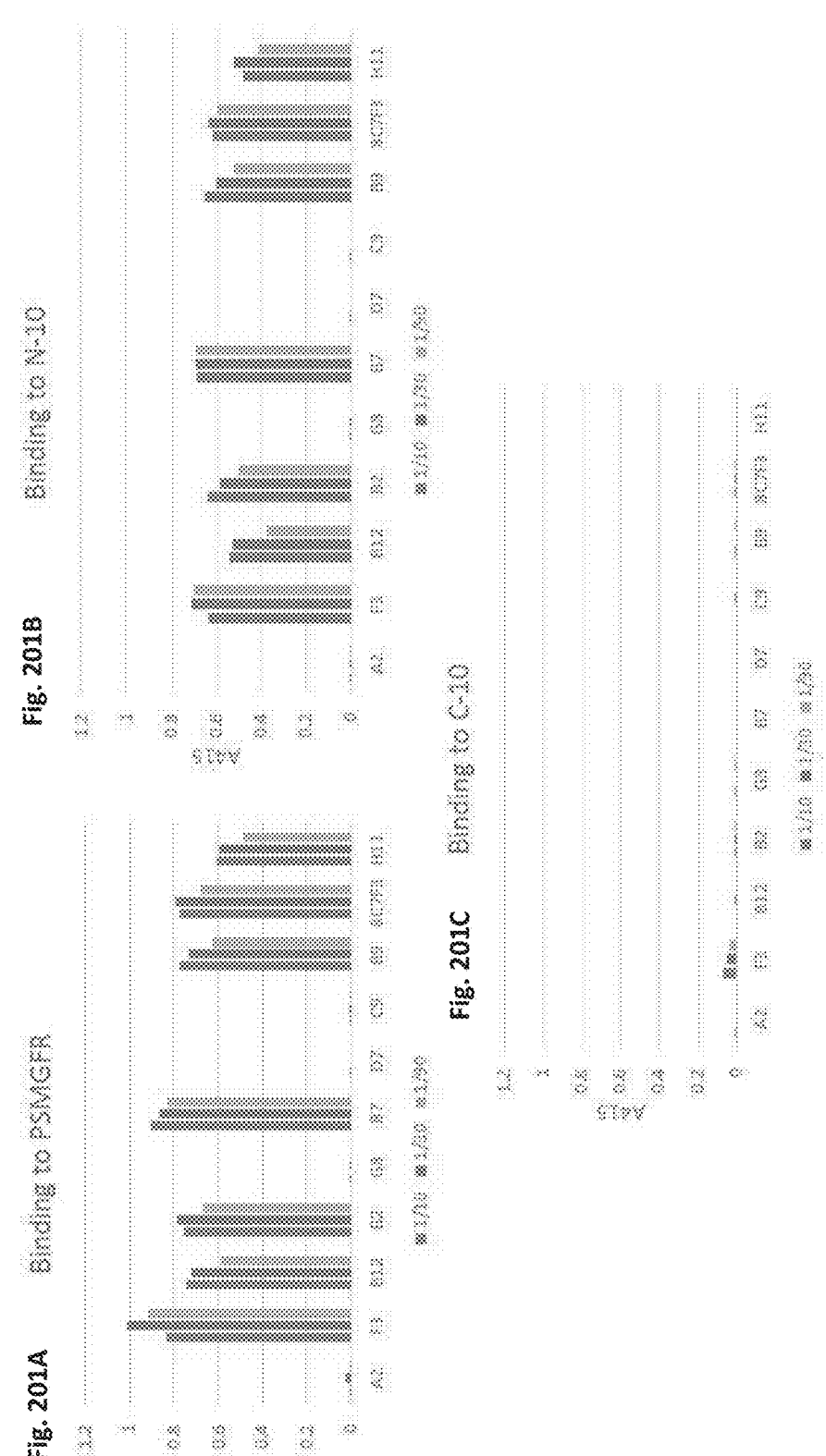

FIG. 201A-201C show graphs of ELISA assays to determine the binding of another set of antibodies generated by immunizing animals with the PSMGFR peptide. FIG. 201A shows binding to the PSMGFR peptide. FIG. 201B shows binding to the N-10 peptide. FIG. 201C shows binding to the C-10 peptide. As can be seen, none of the antibodies bound to the C-10 peptide. F3, B12, B2, B7, B9, 8C7F3 and H11 all bound to the PSMGFR peptide and to the N-10 peptide.

Figures 202A, 202B, 202C:
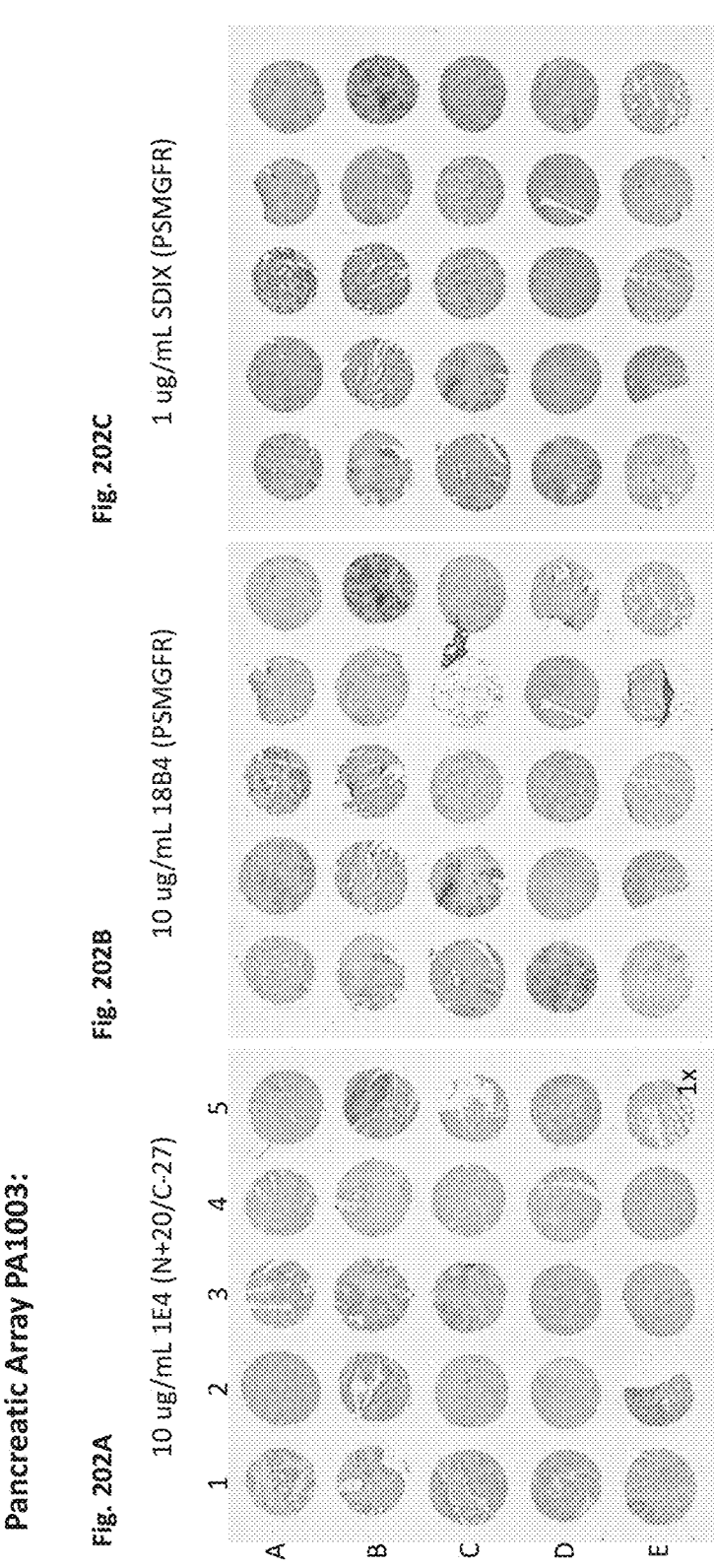

FIG. 202A-202C shows photographs of pancreatic cancer tissue array PA1003 that has been stained with monoclonal antibody 1E4, monoclonal antibody 18B4 or the polyclonal anti-PSMGFR antibody SDIX. 18B4 binds to the GTINVHDVET (SEQ ID NO: 1746) epitope at the most N-terminal portion of the PSMGFR peptide, while the 1E4 antibody binds to the QFNQYKTEA (SEQ ID NO: 1749) epitope that is immediately adjacent and C-terminal to the 18B4 epitope.

Figures 203A, 203B, 203C, 203D, 203E, 203F:
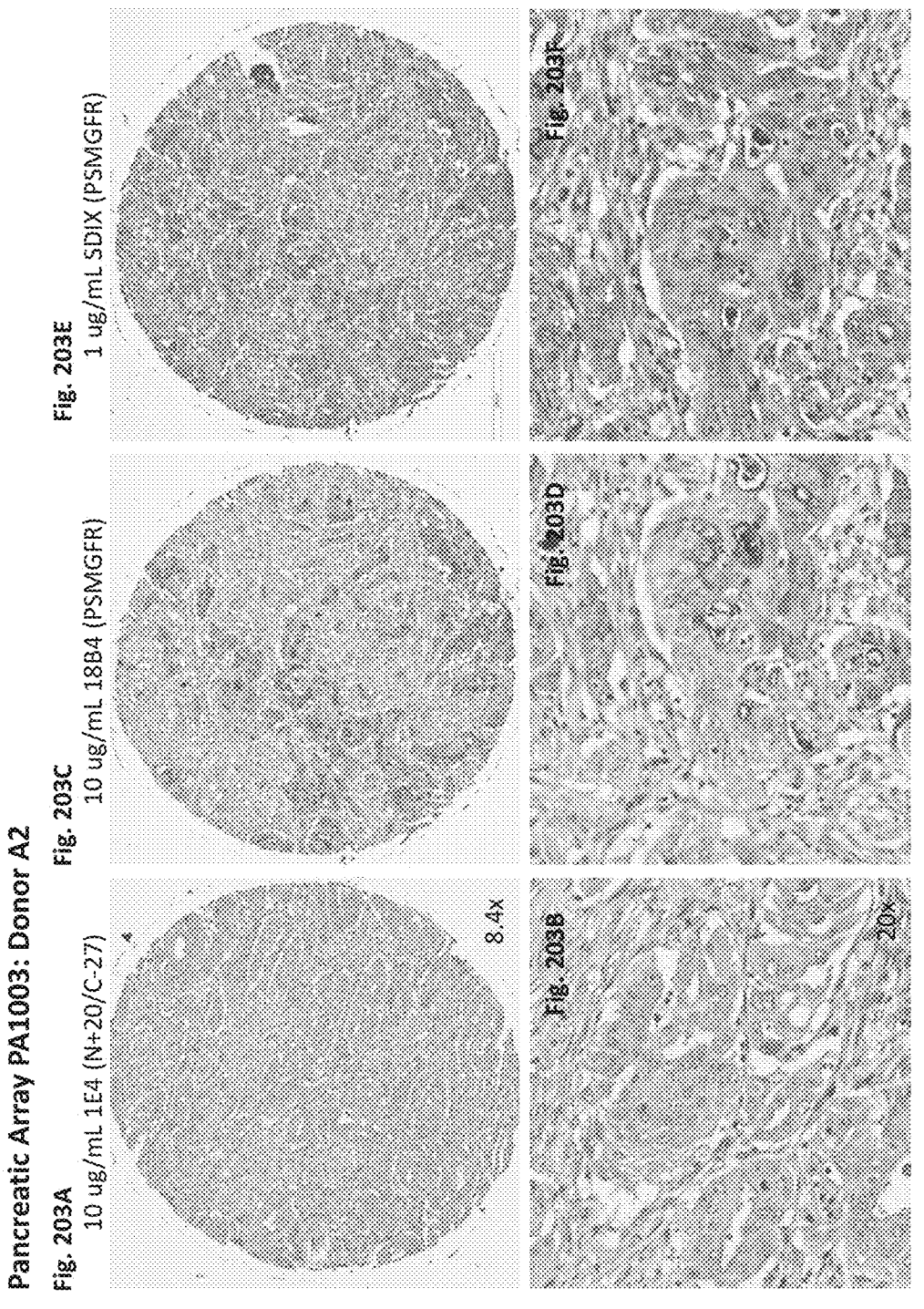

FIG. 203A-203F shows magnified images of the tissue specimen at position A2 of the pancreatic cancer array PA1003. FIG. 203A and FIG. 203B show the specimen stained with antibody 1E4. FIG. 203C and FIG. 203D show the specimen stained with antibody 18B4. FIG. 203E and FIG. 203F show the specimen stained with polyclonal antibody SDIX.

Figures 204A, 204B, 204C, 204D:
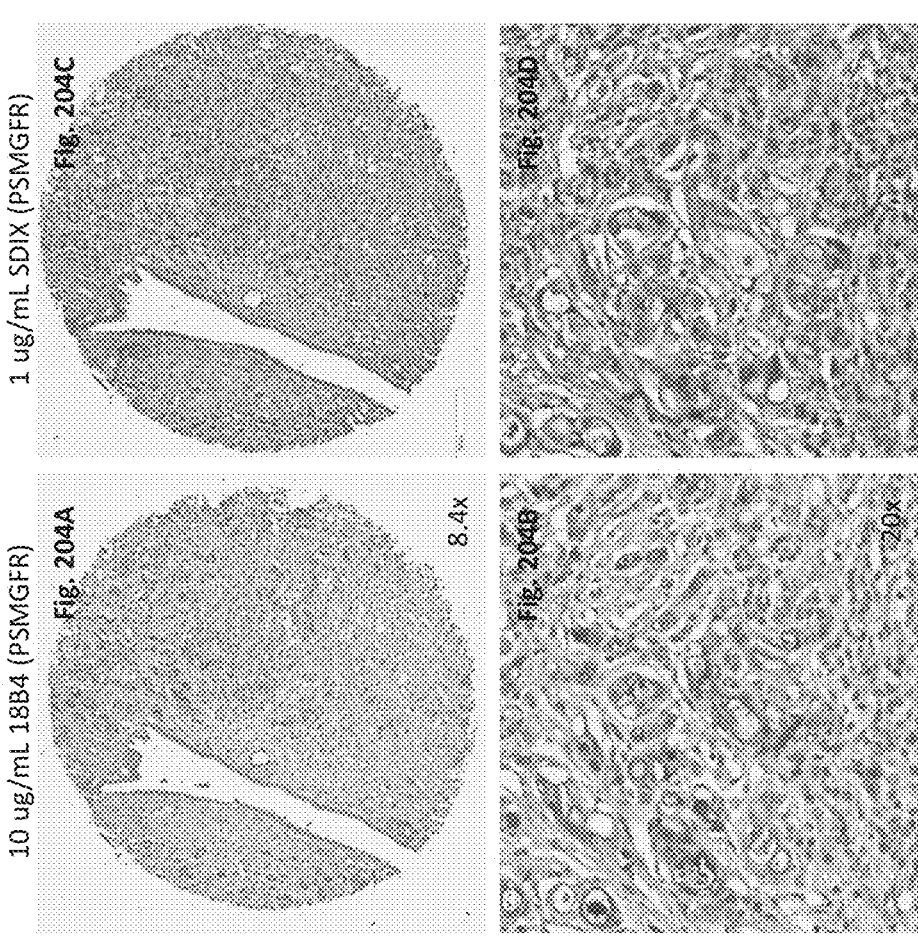

FIG. 204A-204D shows magnified images of the tissue specimen at position D4 of the pancreatic array PA1003. FIG. 204A and FIG. 204B show the specimen stained with antibody 18B4. FIG. 204C and FIG. 204D show the specimen stained with polyclonal antibody SDIX.

Figures 205A, 205B, 205C, 205D:
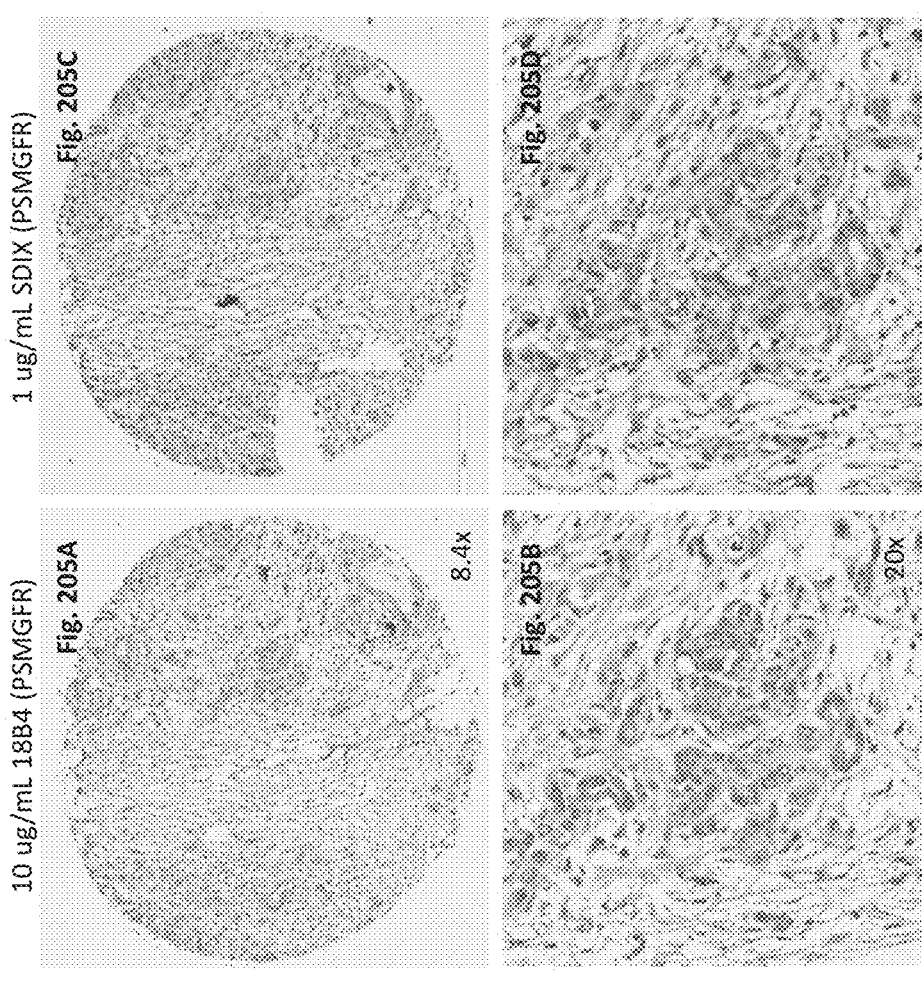

FIG. 205A-205D shows magnified images of the tissue specimen at position E1 of the pancreatic cancer array PA1003. FIG. 205A and FIG. 205B show the specimen stained with antibody 18B4. FIG. 205C and FIG. 205D show the specimen stained with polyclonal antibody SDIX.

Figures 206A, 206B, 206C, 206D:
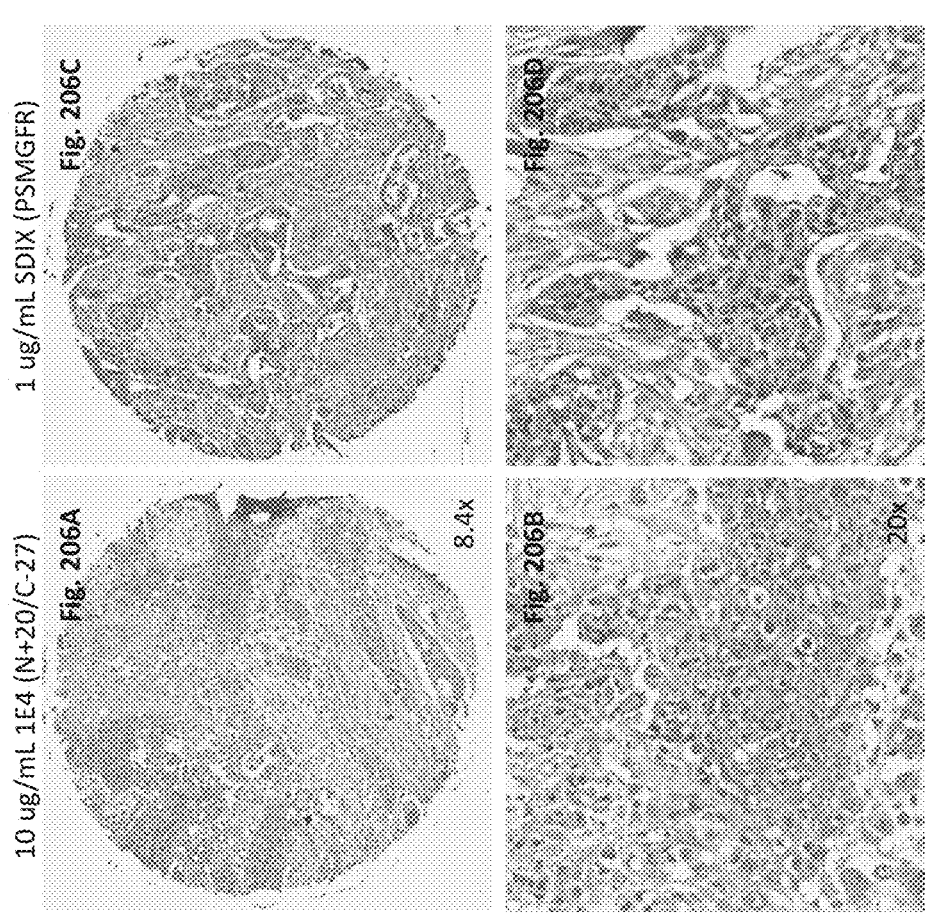

FIG. 206A-206D shows magnified images of the tissue specimen at position C3 of the pancreatic cancer array PA1003. FIG. 206A and FIG. 206B show the specimen stained with antibody 1E4. FIG. 206C and FIG. 206D show the specimen stained with polyclonal antibody SDIX.

Figures 207A, 207B, 207C, 207D:
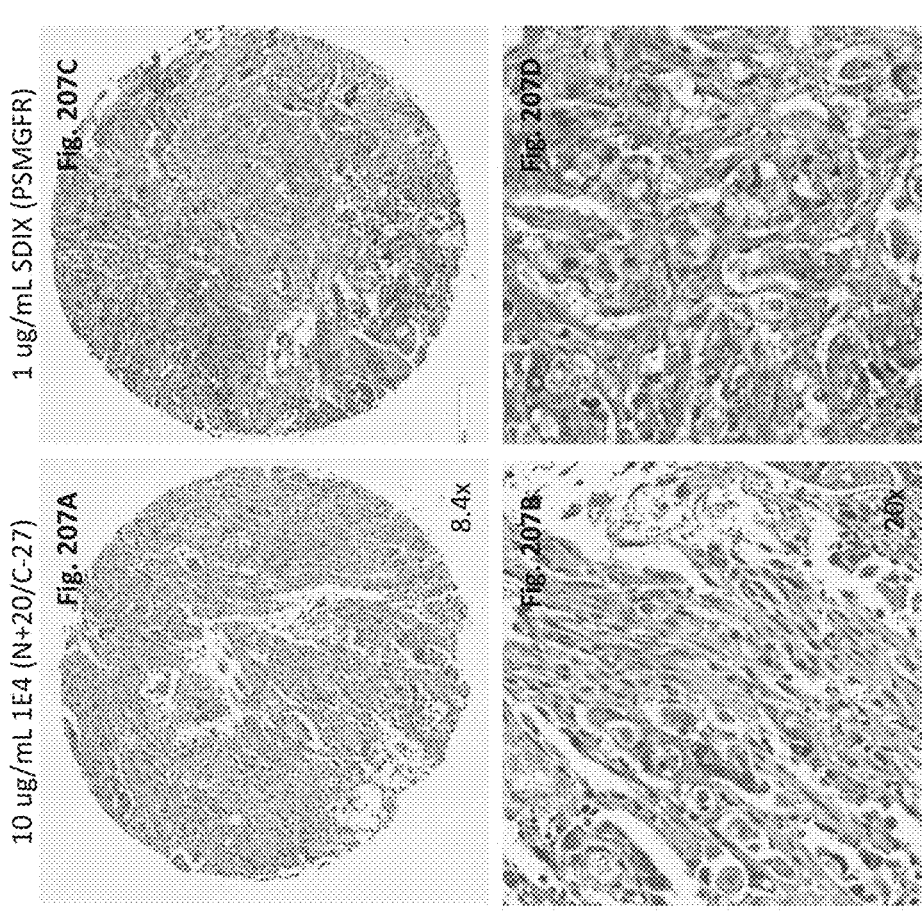

FIG. 207A-207D shows magnified images of the tissue specimen at position D1 of the pancreatic cancer array PA1003. FIG. 207A and FIG. 207B show the specimen stained with antibody 1E4. FIG. 207C and FIG. 207D show the specimen stained with polyclonal antibody SDIX.

Figures 208A, 208B, 208C:
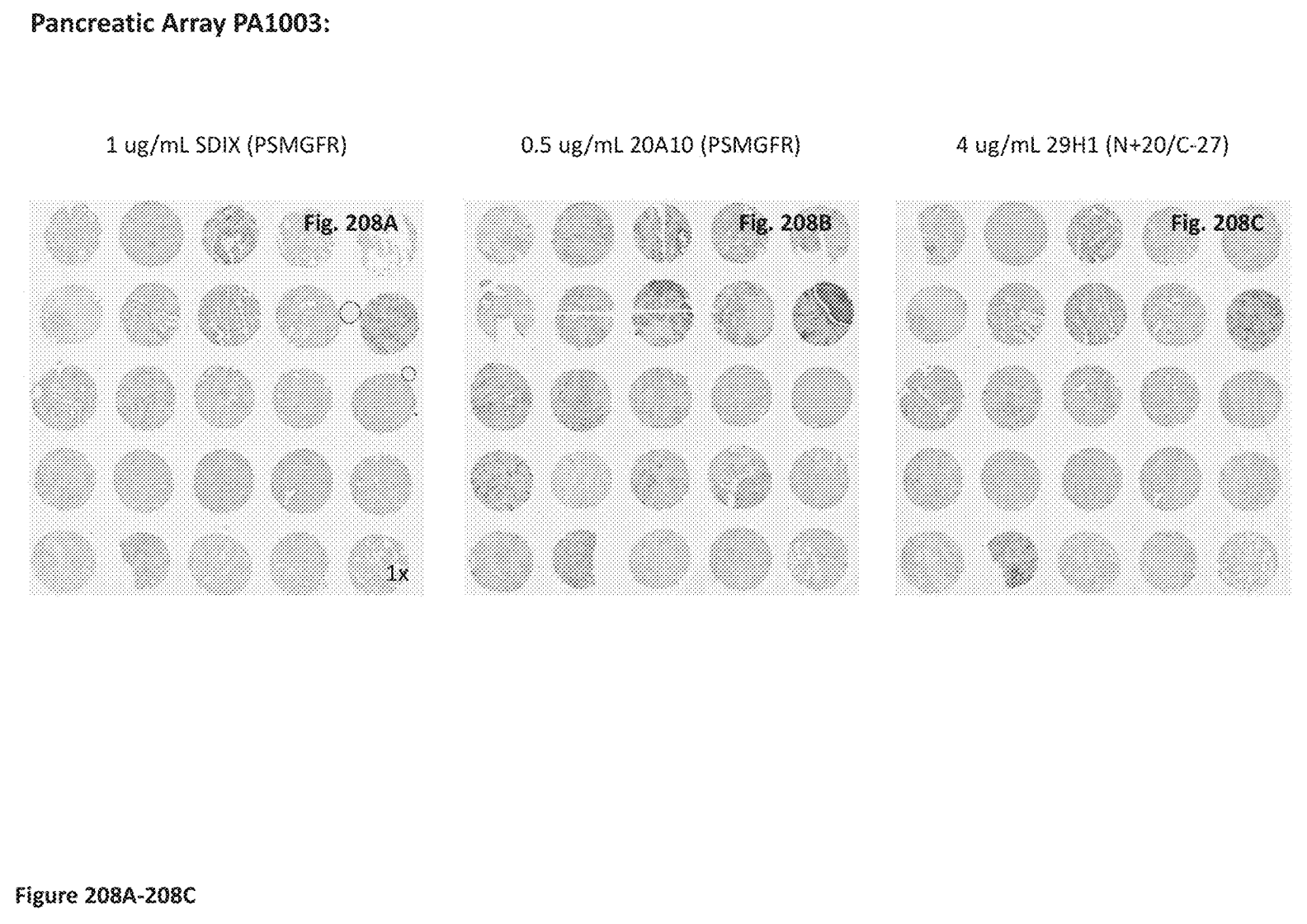

FIG. 208A-208C shows photographs of the pancreatic cancer array PA1003. FIG. 208A shows the specimen stained with polyclonal antibody SDIX. FIG. 208B shows the specimen stained with antibody 20A10. FIG. 208C shows the specimen stained with antibody 29H1.

FIG. 209A-209D shows photographs of the esophageal cancer array ES1001 stained with various antibodies. FIG. 209A shows the array stained with polyclonal antibody SDIX. FIG. 209B shows the array stained with antibody 20A10. FIG. 209C shows the array stained with antibody 29H1. FIG. 209D shows the array stained with antibody 31A1.

Figures 210A, 210B, 210C:
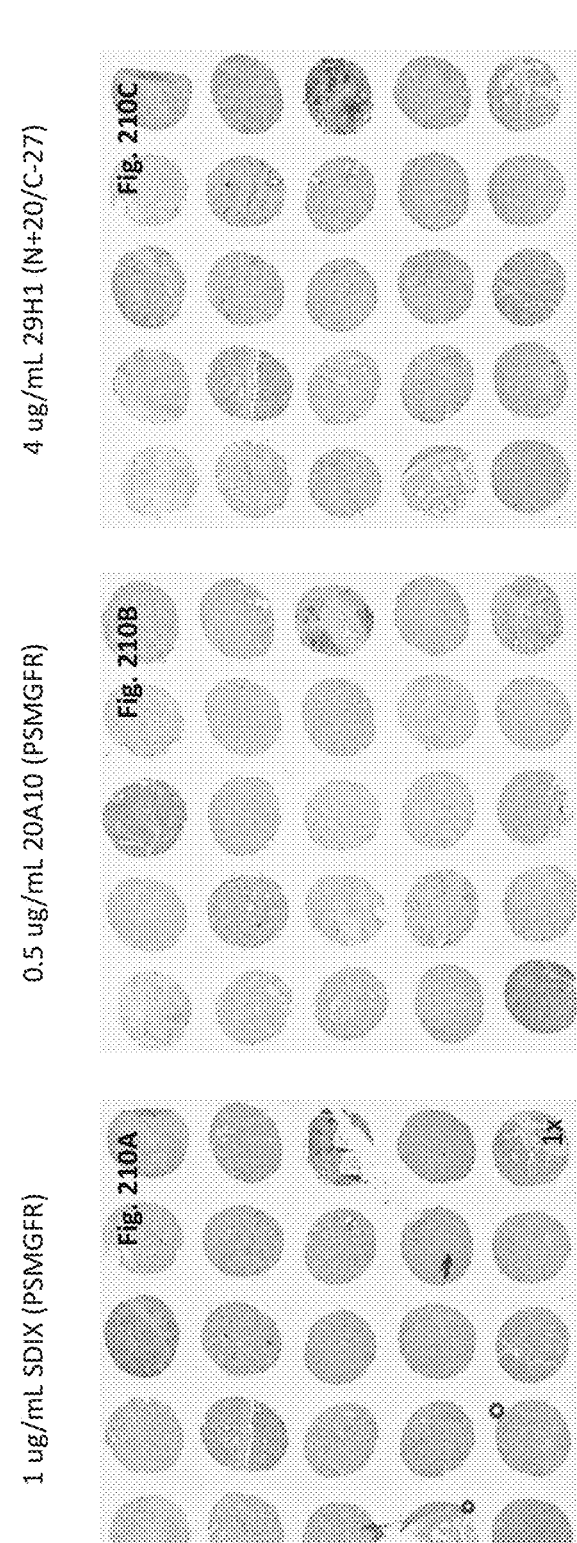

FIG. 210A-210C shows photographs of the pancreatic cancer array PA1003 stained with various antibodies. FIG. 210A shows the array stained with polyclonal antibody SDIX. FIG. 210B shows the array stained with antibody 20A10. FIG. 210C shows the array stained with antibody 29H1.

Figures 211A, 211B, 211C:
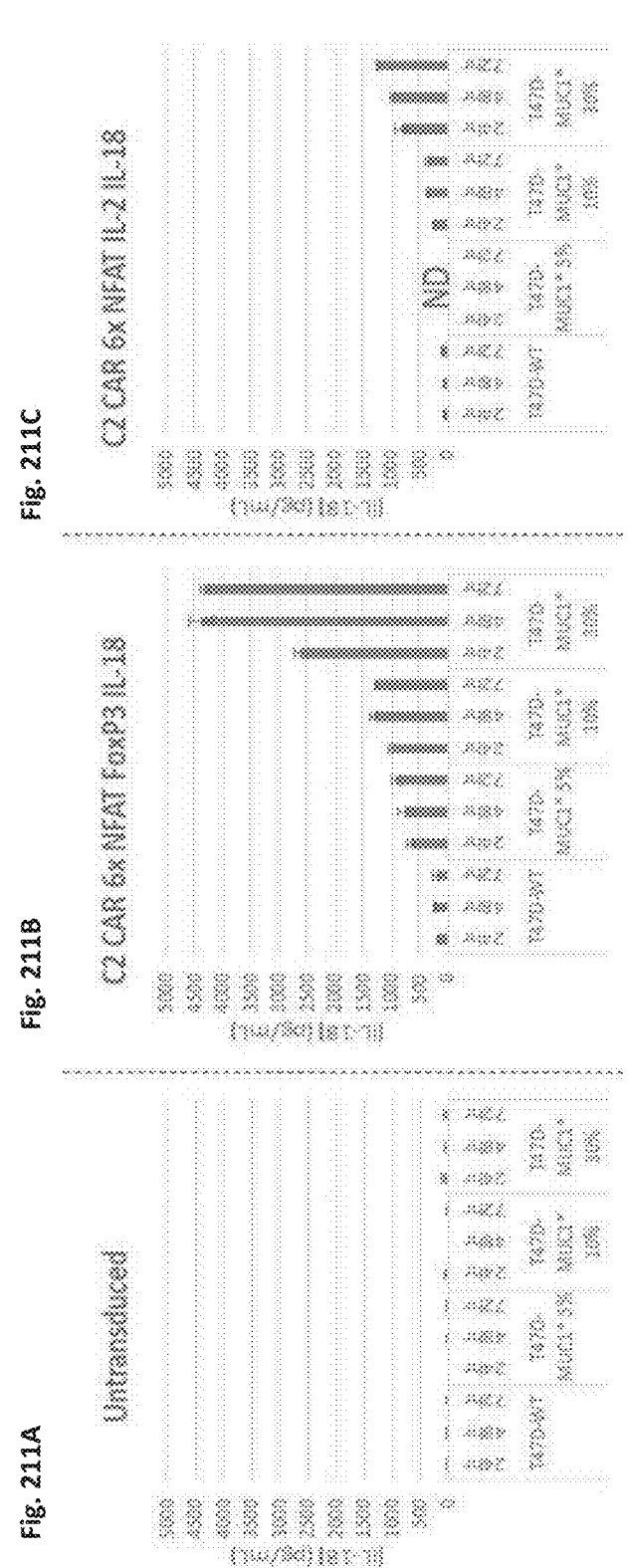

FIG. 211A-211C show graphs of an ELISA experiment measuring the amount of IL-18 secreted into the condition media of MUC1* positive cancer cells co-cultured with huMNC2-CAR44 T cells wherein the cells also bear an NFAT inducible IL-18. FIG. 211A shows the graph of IL-18 secreted into the supernatant of T47D breast cancer cells co-cultured with untransduced human T cells. FIG. 211B shows the graph of IL-18 secreted into the supernatant of T47D breast cancer cells co-cultured with huMNC2-CAR44 T cells that also bore an NFAT inducible IL-18 gene inserted into a portion of the Foxp3 enhancer. FIG. 211C shows the graph of IL-18 secreted into the supernatant of T47D breast cancer cells co-cultured with huMNC2-CAR44 T cells that also bore an NFAT inducible IL-18 gene inserted into a portion of the IL-2 enhancer.

Figures 212A, 212X:
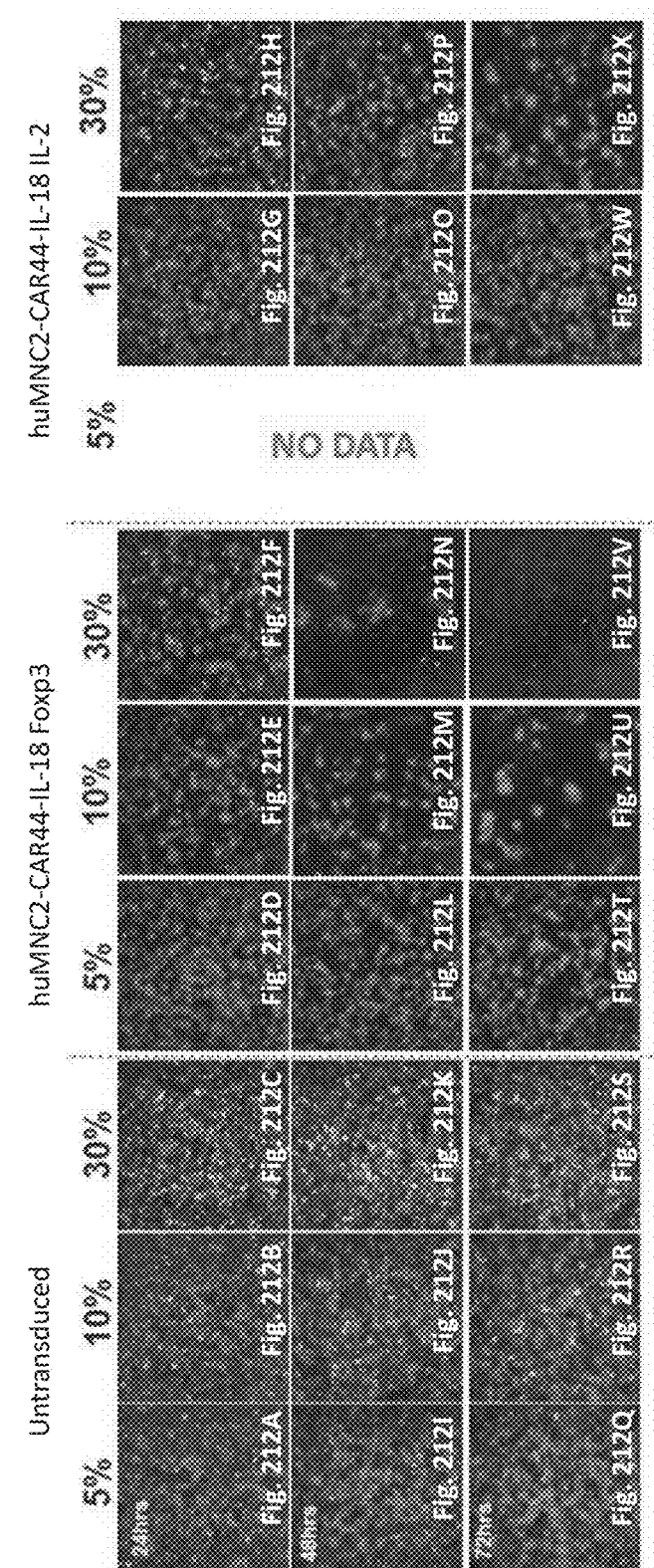

FIG. 212A-212X shows photographs of T47D breast cancer cells (red) doped with varying percentages of T47D cells engineered to express more MUC1* (green). The target cancer cells have been co-cultured with huMNC2-CAR44 T cells with NFAT inducible IL-18 wherein the IL-18 gene has been inserted into either the Foxp3 enhancer/promoter or the IL-2 enhancer/promoter. FIGS. 212A-212C, 212I-212K, and 212Q-212S show the cancer cells co-cultured with untranduced T cells. FIGS. 212D-212F, 212L-212N, and 212T-212V show the cancer cells co-cultured with hiMNC2-CAR44 T cells with the NFAT inducible IL-18 gene inserted into the Foxp3 enhancer/promoter. FIGS. 212G-212H, 2120-212P, and 212W-212X show the cancer cells co-cultured with hiMNC2-CAR44 T cells with the NFAT inducible IL-18 gene inserted into the IL-2 enhancer/promoter.

Figures 213A, 213B:

FIG. 213A-213B shows graphs of ELISA experiments in which levels of IL-18 secreted into the conditioned media are measured for huMNC1-CAR44 T cells with NFAT inducible IL-18 gene, inserted into the Foxp3 enhancer or promoter, co-cultured with either MUC1* positive cancer cells or MUC1 negative non-cancerous cells. FIG. 213A shows IL-18 secretion from huMNC2-CAR44 T cells with NFAT inducible IL-18 in co-culture with T47D breast cancer cells where the population has been doped with 5%, 10% or 30% T47D cells that had been transfected with even more MUC1*. FIG. 213B shows IL-18 secretion from huMNC2-

CAR44 T cells with NFAT inducible IL-18 in co-culture with non-cancerous, MUC1 negaive HEK293 cells where the cell population has been doped with 5%, 10% or 30% T47D cells that had been transfected with more MUC1*.

Figures 214A, 214X:
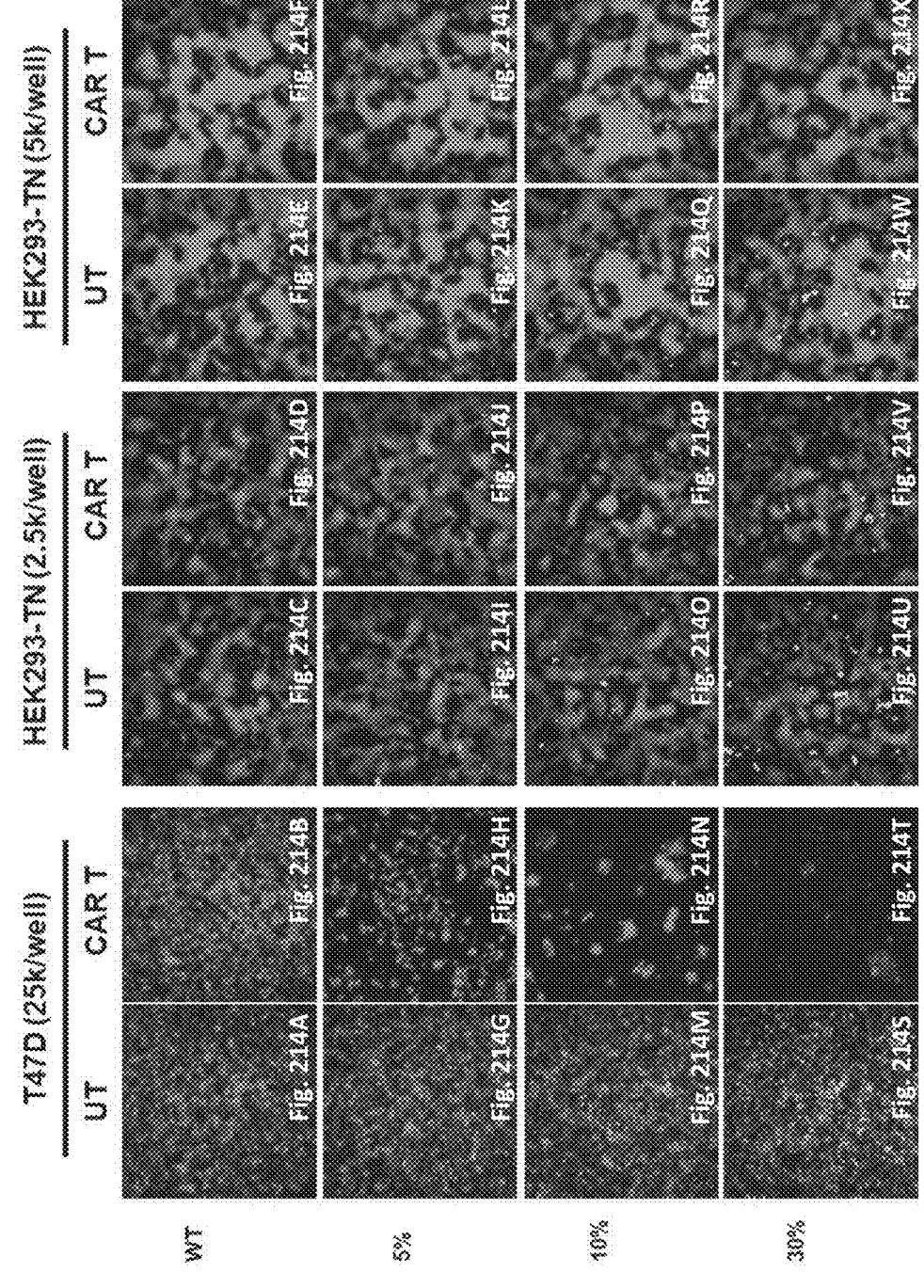

FIG. 214A-214X shows photographs of T47D breast cancer cells (red) or non-cancerous HEK293 cells (also red), where both cell types have been doped with varying percentages of T47D cells engineered to express more MUC1* (green). These target cancer cells have been co-cultured with huMNC2-CAR44 T cells with NFAT inducible IL-18 wherein the IL-18 gene has been inserted into the Foxp3 enhancer/promoter. FIG. 214A-214F shows either T47D cells or HEK293 cells that have not been doped with T47D cells engineered to express high MUC1* density. FIG. 214G-214L shows either T47D cells or HEK293 cells that have been doped with 5% T47D cells engineered to express high MUC1* density. FIG. 214M-214R shows either T47D cells or HEK293 cells that have been doped with 10% T47D cells engineered to express high MUC1* density. FIG. 214S-214X shows either T47D cells or HEK293 cells that have been doped with 30% T47D cells engineered to express high MUC1* density. FIGS. 214A-B, G-H, M-N, and S-T show T47D breast cancer cells. FIGS. 214C-F, I-L, O-R, and U-X show HEK293 cells. As can be seen in the figures, the induced secretion of IL-18 resulted in low MUC1* density T47D cells being killed but did not induce non-specific killing of the MUC1* negative HEEK293 cells.

FIG. 215A-215C shows the consensus sequences of the heavy chain CDRs wherein the consensus sequences were generated for each group of antibodies that bound to the same epitope in the PSMGFR and N-terminally extended PSMGFR peptide. FIG. 215A shows consensus sequences for heavy chain CDR1. FIG. 215B shows consensus sequences for heavy chain CDR2. FIG. 215C shows consensus sequences for heavy chain CDR3. Figure discloses "SNIKFRPGSVVVQLTLAFREGTINVHD-VETQFNQYKTEAASRYNLTISDVSVSDVPFPFS AQSGA" as SEQ ID NO: 822.

FIG. 216A-216C shows the consensus sequences of the light chain CDRs wherein the consensus sequences were generated for each group of antibodies that bound to the same epitope in the PSMGFR and N-terminally extended PSMGFR peptide. FIG. 216A shows consensus sequences for light chain CDR1. FIG. 216B shows consensus sequences for light chain CDR2. FIG. 216C shows consensus sequences for light chain CDR3. Figure discloses "SNIKFRPGSVVVQLTLAFREGTINVHD-VETQFNQYKTEAASRYNLTISDVSVSDVPFPFS AQSGA" as SEQ ID NO: 822.

DETAILED DESCRIPTION OF THE PREFERRED EMBODIMENTS

In the present application, "a" and "an" are used to refer to both single and a plurality of objects.

As used herein, occasionally, in short hand, a polypeptide is indicated as being "transduced or transfected" into a cell. In these occurrences, it is understood that the nucleic acid encoding the polypeptide sequence is transduced or transfected into the cell, as it is an impossibility that a polypeptide could be transduced or transfected into a cell.

As used herein, occasionally when referring to number of cells injected into an animal or otherwise contextually wherein the number of cells is referred to, "M" refers to millions, and "K" refers to thousands.

As used herein, interchangeable designations for various monoclonal antibodies are used, such as, "MN-C2", which is interchangeable with "C2", "Min-C2" and "MNC2"; "MN-E6", which is interchangeable with "E6", "Min-E6" and "MNE6"; "MN-C3", which is interchangeable with "C3", "Min-C3" and "MNC3"; and "MN-C8", which is interchangeable with "C8", "Min-C8" and "MNC8". The monoclonal antibodies provided herein follow the same convention.

As used herein, "h" or "hu" placed before an antibody construct is short-hand for humanized.

As used herein, the term "antibody-like" means a molecule that may be engineered such that it contains portions of antibodies but is not an antibody that would naturally occur in nature. Examples include but are not limited to CAR (chimeric antigen receptor) T cell technology and the Ylanthia® technology. The CAR technology uses an antibody epitope fused to a portion of a T cell so that the body's immune system is directed to attack a specific target protein or cell. The Ylanthia® technology consists of an "antibody-like" library that is a collection of synthetic human Fabs that are then screened for binding to peptide epitopes from target proteins. The selected Fab regions can then be engineered into a scaffold or framework so that they resemble antibodies.

As used herein, "PSMGFR" is abbreviation for Primary Sequence of the MUC1 Growth Factor Receptor which is identified by SEQ ID NO:2, and thus is not to be confused with a six amino acid sequence. "PSMGFR peptide" or "PSMGFR region" refers to a peptide or region that incorporates the Primary Sequence of the MUC1 Growth Factor Receptor (SEQ ID NO: 2).

As used herein, the "MUC1*" extra cellular domain is defined primarily by the PSMGFR sequence (GTINVHD-VETQFNQYKTEAAS-RYNLTISDVSVSDVPFPFSAQSGA (SEQ ID NO:2)). Because the exact site of MUC1 cleavage depends on the enzyme that clips it, and that the cleavage enzyme varies depending on cell type, tissue type or the time in the evolution of the cell, the exact sequence of the MUC1* extra cellular domain may vary at the N-terminus.

Other clipped amino acid sequences may include SNIKFRPGSVVVQLTLAFREGTINVHDVETQFNQYK-TEAASRY (SEQ ID NO:620); or SVVVQLTLAFREGT-INVHDVETQFNQYKTEAASRY (SEQ ID NO:621).

As used herein, the term "PSMGFR" is an acronym for Primary Sequence of MUC1 Growth Factor Receptor as set forth as GTINVHDVETQFNQYKTEAAS-RYNLTISDVSVSDVPFPFSAQSGA (SEQ ID NO:2). In this regard, the "N-number" as in "N-10 PSMGFR" or simply "N-10", "N-15 PSMGFR" or simply "N-15", or "N-20 PSMGFR" or simply "N-20" refers to the number of amino acid residues that have been deleted at the N-terminal end of PSMGFR. Likewise "C-number" as in "C-10 PSMGFR" or simply "C-10", "C-15 PSMGFR" or simply "C-15", or "C-20 PSMGFR" or simply "C-20" refers to the number of amino acid residues that have been deleted at the C-terminal end of PSMGFR. A mixture of deletions and additions is also possible. For instance, N+20/C-27 refers to a peptide fragment of wild-type MUC1 in which 20 amino acids are added to the PSMGFR at the N-terminus and 27 amino acids are deleted from the C-terminus.

As used herein, the "extracellular domain of MUC1*" refers to the extracellular portion of a MUC1 protein that is devoid of the tandem repeat domain. In most cases, MUC1* is a cleavage product wherein the MUC1* portion consists of a short extracellular domain devoid of tandem repeats, a transmembrane domain and a cytoplasmic tail. The precise location of cleavage of MUC1 is not known perhaps because it appears that it can be cleaved by more than one enzyme. The extracellular domain of MUC1* will include most of the PSMGFR sequence but may have an additional 10-20 N-terminal amino acids.

As used herein "sequence identity" means homology in sequence of a particular polypeptide or nucleic acid to a reference sequence of nucleic acid or amino acid such that the function of the homologous peptide is the same as the reference peptide or nucleic acid. Such homology can be so close with the reference peptide such that at times the two sequences may be 90%, 95% or 98% identical yet possess the same function in binding or other biological activities.

As used herein, "MUC1 positive" cell refers to a cell that expresses a gene for MUC1, MUC1-Y or MUC1-Z or other MUC1 variant.

As used herein, "MUC1 negative" cell refers to a cell that does not express a gene for MUC1.

As used herein, "MUC1* positive" cell refers to a cell that expresses a gene for MUC1, wherein that gene's expressed protein is a transmembrane protein that is devoid of tandem repeats, which may be a consequence of post-translational modification, cleavage, alternative splicing, or transfecting or transducing a cell with a MUC1 protein that is devoid of tandem repeats.

As used herein, "MUC1* negative" cell refers to a cell that may or may not express a gene for MUC1 but does not express a MUC1 transmembrane protein that is devoid of tandem repeats.

As used herein, "MUC1 positive" cancer cell refers to a cancer cell that overexpresses the gene for MUC1, expresses MUC1 in an aberrant pattern, wherein its expression is not restricted to the apical border and/or expresses a MUC1 that is devoid of tandem repeats.

As used herein, "MUC1 negative" cancer cell refers to a cancer cell that may or may not express a gene for MUC1 but does not overexpress MUC1 or does not overexpress a MUC1 transmembrane protein that is devoid of tandem repeats.

As used herein, "MUC1* positive" cancer cell refers to a cancer cell that overexpresses a MUC1 transmembrane protein that is devoid of tandem repeats.

As used herein, "MUC1* negative" cancer cell refers to a cancer cell that may or may not express a gene for MUC1 but does not overexpress a MUC1 transmembrane protein that is devoid of tandem repeats.

As used herein "conformational epitope" refers to a peptide sequence that is required to be present in a specific three-dimensional structure or conformation for an antibody to bind. However the antibody binds when the peptide sequence is in the three-dimensional structure or conformation and is not bound when linear. A common technique for determining whether an antibody binds to a linear stretch or a conformational epitope is to use the antibody to probe a denaturing Western blot. Traveling through a denaturing gel linearizes proteins and peptides. Antibodies that do not work in a denaturing Western but do recognize the native target, for example expressed on an intact cell, are determined to recognize a conformational epitope. As used herein, the antibody may or may not actually bind to the "conformational epitope", however the presence of the "conformational epitope" sequence is required to render a three dimensional structure so that the MUC1* region on cancer cells is able to be bound by the antibody that is specific for cancer treatment. Thus, the conformational epitope is an amino acid sequence that induces the binding of the antibody to the MUC1* region on cancer cells. Thus, a term "conformational inducing peptide sequence" may be used, which indicates that a peptide sequence is present within a larger peptide not as a binding site but that induces binding of an antibody to the larger peptide by causing a three-dimensional structure to form that facilitates the binding of the antibody to the larger peptide.

MUC1* Antibodies (Anti-PSMGFR) for Treatment or Prevention of Cancers

We discovered that a cleaved form of the MUC1 (SEQ ID NO:1) transmembrane protein is a growth factor receptor that drives the growth of over 75% of all human solid tumor cancers. The cleaved form of MUC1, which we called MUC1* (pronounced muk 1 star), is a powerful growth factor receptor. Enzymatic cleavage releases the bulk of the MUC1 extracellular domain. It is the remaining portion comprising a truncated extracellular domain, transmembrane domain and cytoplasmic tail that is called MUC1*. Cleavage and release of the bulk of the extracellular domain of MUC1 unmasks a binding site for activating ligands dimeric NME1, NME6, NME8, NME7$_{AB}$, NME7-X1 or NME7. Cell growth assays show that it is ligand-induced dimerization of the MUC1* extracellular domain that promotes growth (FIG. 1A-1D). MUC1* positive cells treated with either bivalent 'bv' anti-MUC1* antibody, monovalent 'mv' or Fab, NM23-H1 dimers or NME7-AB. Bivalent anti-MUC1* antibodies stimulate growth of cancer cells whereas the monovalent Fab inhibits growth. Classic bell-shaped curve indicates ligand induced dimerization stimulates growth. Dimeric NM23-H1, aka NME1, stimulates growth of MUC1* positive cancer cells but siRNA to suppress MUC1 expression eliminate its effect (FIG. 1C). NME7-AB also stimulates the growth of MUC1* positive cells (FIG. 1D).

MUC1* is an excellent target for cancer drugs as it is aberrantly expressed on over 75% of all cancers and is likely overexpressed on an even higher percentage of metastatic cancers. After MUC1 cleavage, most of its extracellular domain is shed from the cell surface. The remaining portion has a truncated extracellular domain that at least comprises the primary growth factor receptor sequence, PSMGFR (SEQ ID NO:2). Antibodies that bind to the PSMGFR sequence and especially those that competitively inhibit the binding of activating ligands such as NME proteins, including NME1, NME6, NME8, NME7$_{AB}$, NME7-X1 and NME7, are ideal therapeutics and can be used to treat or prevent MUC1 positive or MUC1* positive cancers, as stand-alone antibodies, antibody fragments or variable region fragments thereof incorporated into bispecific antibodies, or chimeric antigen receptors also called CARs, which are then transfected or transduced into immune cells, then administered to a patient.

Therapeutic anti-MUC1* antibodies can be monoclonal, polyclonal, antibody mimics, engineered antibody-like molecules, full antibodies or antibody fragments. Examples of antibody fragments include but are not limited to Fabs, scFv, and scFv-Fc. Human or humanized antibodies are preferred for use in the treatment or prevention of cancers. In any of these antibody-like molecules, mutations can be introduced to prevent or minimize dimer formation. Anti-MUC1* antibodies that are monovalent or bispecific are preferred because MUC1* function is activated by ligand induced dimerization. Typical binding assays show that NME1 and NME7$_{AB}$ bind to the PSMGFR peptide portion of MUC1* (FIG. 2A, 2D). Further, they show that these activating growth factors bind to the membrane proximal portion of MUC1*, as they do not bind to the PSMGFR peptide if the 10 C-terminal amino acids are missing. Similarly, anti-MUC1* antibodies MN-C2 and MN-E6 bind to the PSMGFR peptide if an only if the 10 C-terminal amino acids are present (FIG. 2B, 2C). Antibodies MN-C3 and MN-C8 bind to epitopes that are different from MN-C2 and MN-E6, as they do not depend on the presence of the 10 C-terminal amino acids of the PSMGFR peptide (FIG. 2E, 2F). Antibodies MN-C2, MN-E6, or fragments derived from them, can be administered to a patient for the treatment or prevention of cancers, as stand-alone antibodies or incorporated into bispecific antibodies, BiTEs or chimeric antigen receptors also called CARs that have been transduced into immune cells. MNC2 and MNE6 and other anti-MUC1* antibodies that competitively inhibit the binding of NME1 and NME7$_{AB}$ are preferred for use as stand alone antibody therapeutics.

Therapeutic anti-MUC1* antibodies for use as a stand alone antibody therapeutic or for integration into a BiTE or a CAR can be selected based on specific criteria. The parent antibody can be generated using typical methods for generating monoclonal antibodies in animals. Alternatively, they can be selected by screening antibody and antibody fragment libraries for their ability to bind to a MUC1* peptide, which can be:

(i) PSMGFR region of MUC1;

(ii) PSMGFR peptide;

(iii) a peptide having amino acid sequence of QFNQYK-TEAASRYNLTISDVSVSDVPFPFSAQSGA (N-10) (SEQ ID NO: 3)

(iv) a peptide having amino acid sequence of ASRYNLTISDVSVSDVPFPFSAQSGA (N-19) (SEQ ID NO: 4)

(v) a peptide having amino acid sequence of NLTISDVSVSDVPFPFSAQSGA (N-23) (SEQ ID NO: 5)

(vi) a peptide having amino acid sequence of ISDVSVSDVPFPFSAQSGA (N-26) (SEQ ID NO: 6)

(vii) a peptide having amino acid sequence of SVSDVPFPFSAQSGA (N-30) (SEQ ID NO: 7)

(viii) a peptide having amino acid sequence of QFNQYKTEAASRYNLTISDVSVSDVPFPFS (N-10/C-5) (SEQ ID NO: 8)

(ix) a peptide having amino acid sequence of ASRYNLTISDVSVSDVPFPFS (N-19/C-5) (SEQ ID NO: 9) or (x) a peptide having amino acid sequence of FPFSAQSGA (N-36) (SEQ ID NO: 10).

Resultant antibodies or antibody fragments generated or selected in this way can then be further selected by passing additional screens. For example, antibodies or antibody fragments become more preferred based on their ability to bind to MUC1* positive cancer cells or tissues but not to MUC1 negative cancer cells or to normal tissues. Further, anti-MUC1* antibodies or antibody fragments may be de-selected as anti-cancer therapeutics if they bind to stem or progenitor cells. Anti-MUC1* antibodies or antibody fragments become more preferred if they have the ability to competitively inhibit the binding of activating ligands to MUC1*. FIGS. 3A-3C shows that MN-E6 and MN-C2 competitively inhibit the binding of activating ligands NME1 and NME7 to MUC1*.

A process for selecting anti-MUC1* antibodies for use in treating a patient diagnosed with a MUC1 positive cancer, at risk of developing a MUC1 positive cancer or suspected of having a MUC1 positive cancer comprises one or more of the following steps of selecting antibodies or antibody fragments that 1) bind to the PSMGFR peptide; 2) bind to the N-10 PSMGFR peptide; 3) bind to cancer cells; 4) do not bind to stem or progenitor cells; and 5) competitively inhibited the binding of dimeric NME1 or NME7-AB to the PSMGFR peptide. For example, FIGS. 3A-3C show that monoclonals MN-E6 and MN-C2 satisfy all five criteria, while monoclonals MN-C3 and MN-C8 do not competitively inhibit the binding of activating ligands NME1 and NME7 (FIG. 3C). Recall that the MUC1* growth factor receptor is activated by ligand-induced dimerization of its extracellular domain. Therefore, the ideal antibody therapeutic should not dimerize the MUC1* extracellular domain. Preferably, suitable antibodies in this regard include monovalent antibodies such as those generated in lamas and camels, Fabs, scFv's, single domain antibodies (sdAb), scFv-Fc as long as the Fc portion is constructed such that it does not homo-dimerize.

Figure 5:
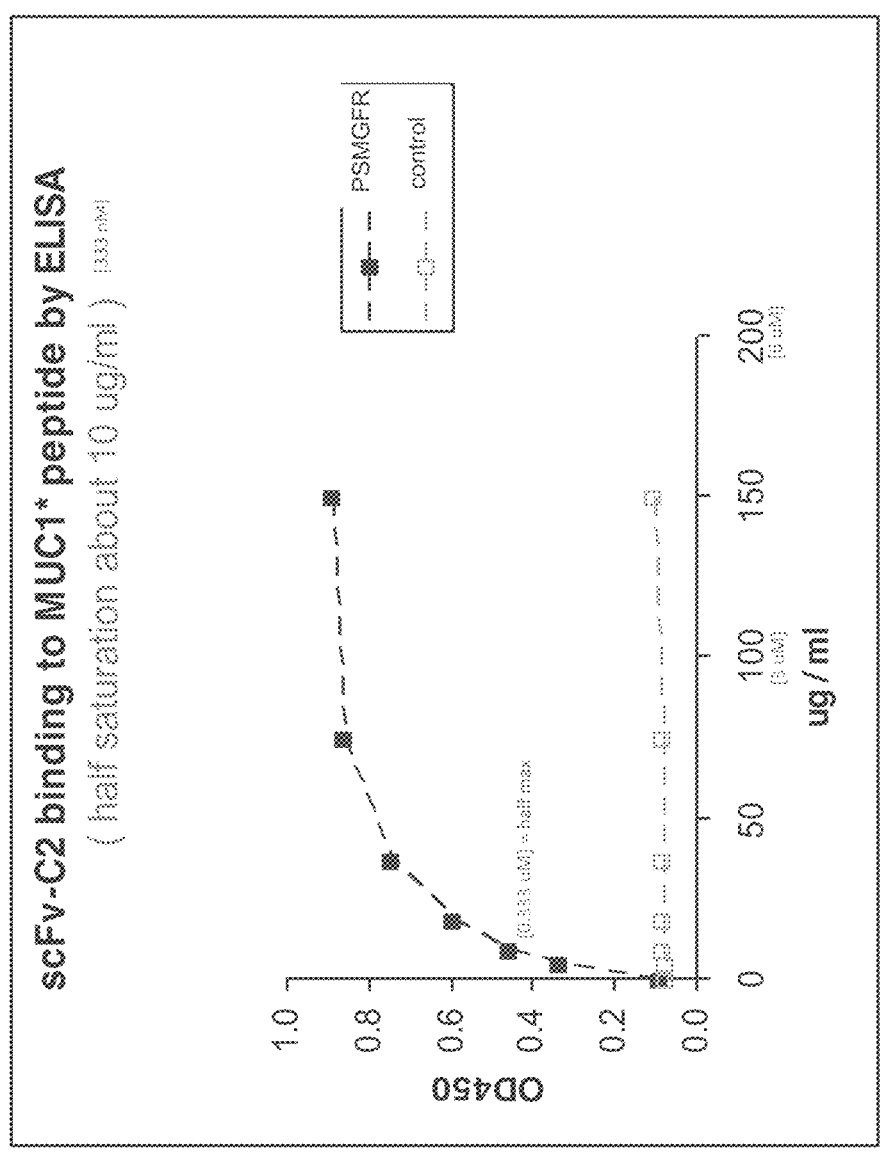
FIG. 5 shows a graph of an ELISA in which surface is coated with either the MUC1* PSMGFR peptide or a control peptide. Humanized MN-C2 scFv is then incubated with the surface, washed and detected according to standard methods. The ELISA shows that the huMN-C2 scFv binds to the MUC1* peptide with an EC-50 of about 333 nM.
Figure 8:
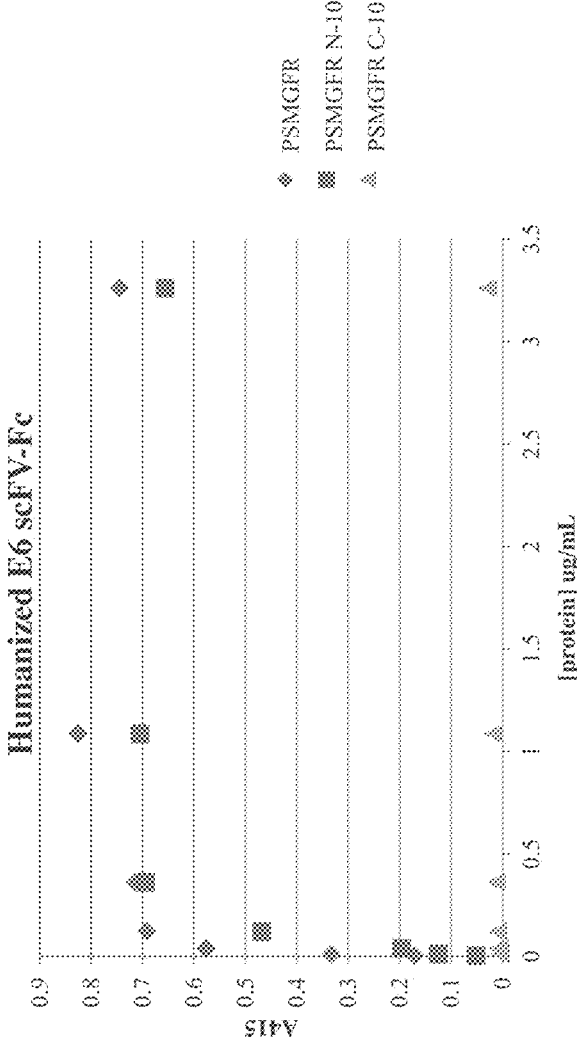
FIG. 8 shows a graph of an ELISA wherein the surface was immobilized with either PSMGFR peptide, PSMGFR minus 10 amino acids from the N-terminus or minus 10 amino acids from the C-terminus. The huMN-E6 scFv-Fc bound to the PSMGFR peptide and to the PSMGFR N-10 peptide but not to the PSMGFR C-10 peptide. The parent MN-E6 antibody and the humanized MN-E6 require the C-terminal 10 amino acids of PSMGFR for binding.

FACS scans show that anti-MUC1* antibodies MN-C2 and MN-E6 specifically bind to MUC1* positive solid tumor cancer cells and MUC1* transfected cells but not MUC1* negative or MUC1 negative cells. In one example, a humanized MN-C2 scFv is shown to bind to ZR-75-1, aka 1500, MUC1* positive breast cancer cells (FIG. 4A-4C). MN-E6 was shown to bind to MUC1 negative HCT-116 colon cancer cells if an only if they were transfected with MUC1*. MN-E6 also bound to MUC1* positive cancer cells such as ZR-75-1, aka 1500, MUC1* positive breast cancer cells (FIG. 4D-4F). Binding assays such as ELISAs, immuno-fluorescence, and the like all confirm that MN-C2 and MN-E6 bind to the PSMGFR peptide and to live MUC1 positive cancer cells. Humanized anti-MUC1* antibodies are selected based on their ability to also bind to the PSMGFR peptide or to MUC1 positive cancer cells. FIG. 5 shows that humanized MN-C2 scFv binds with high affinity to the MUC1* peptide PSMGFR with an EC-50 of about 333 nM. Humanized MN-C2 scFv, like Fabs, potently inhibits the growth of MUC1* positive cancer cells as is shown in one example in FIGS. 6A, 6B. Like the parent antibodies, humanized scFv's show the same binding pattern. huMNE6-scFv binds to the PSMGFR peptide, binds to the N-10 peptide but does not bind to the C-10 peptide (SEQ ID NO: 825) (FIG. 8). Murine or humanized MNC3-scFv binds to the, PSMGFR peptide, binds to the N-10 peptide and binds to the C-10 peptide (FIG. 9).

Figure 7B:
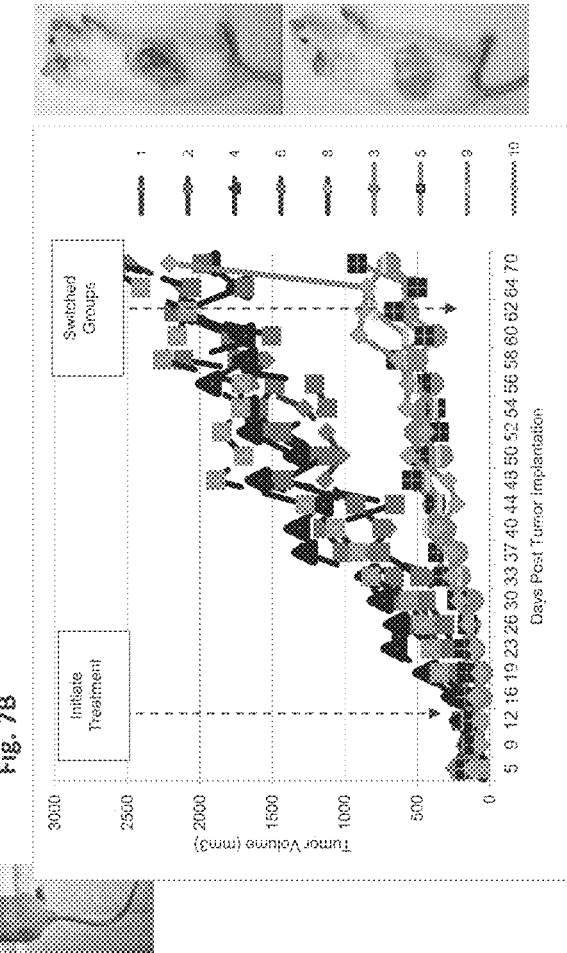
FIGS. 7A-7B show graphs of tumor growth in immune compromised mice that have been implanted with human tumors then treated with anti-MUC1* antibody MN-E6 Fab or mock treatment. Female nu/nu mice implanted with 90-day estrogen pellets were implanted with 6 million T47D human breast cancer cells that had been mixed 50/50 with Matrigel. Mice bearing tumors that were at least 150 mm³ and had three successive increases in tumor volume were selected for treatment. Animals were injected sub cutaneously twice per week with 80 mg/kg MN-E6 Fab and an equal number of mice fitting the same selection criteria were injected with vehicle alone (FIG. 7A). Male NOD/SCID mice were implanted with 6 million DU-145 human prostate cancer cells that had been mixed 50/50 with Matrigel. Mice bearing tumors that were at least 150 mm³ and had three successive increases in tumor volume were selected for treatment. Animals were injected sub-cutaneously every 48 hours with 160 mg/kg MN-E6 Fab and an equal number of mice fitting the same selection criteria were injected with vehicle alone (FIG. 7B). Tumors were measured independently by two researchers twice per week and recorded. Statistics were blindly calculated by independent statistician, giving a P value of 0.0001 for each. Anti-MUC1* Fab inhibited breast cancer growth and prostate cancer growth. Treatment had no effect on weight, bone marrow cell type or number.
Figure 7A:
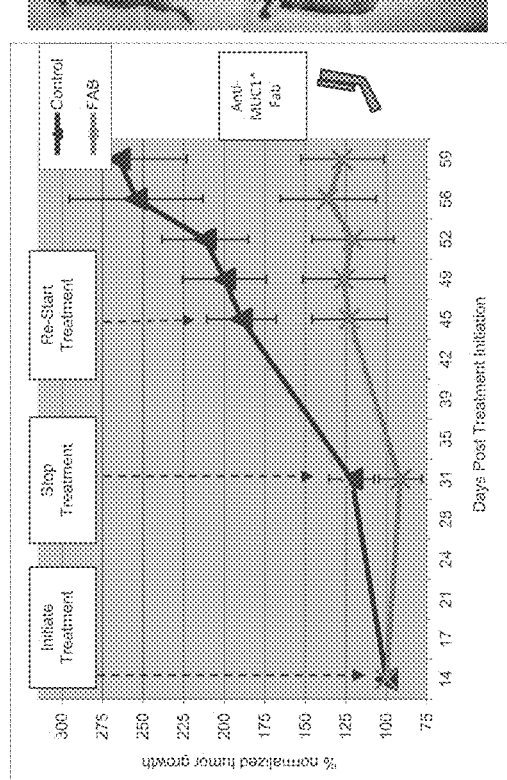

The Fabs of MN-E6 and MN-C2 or the comparable single chain variable regions derived from them potently inhibit the growth of MUC1* positive cancers in vitro and in vivo. In several examples, the Fabs of Anti-MUC1* antibodies inhibited the growth of human MUC1* positive cancers in vivo. In one case, immune-compromised mice were implanted with human breast tumors then treated with MN-E6 Fab after tumor engraftment. FIG. 7A shows that MN-E6 Fab potently inhibited the growth of MUC1* positive breast cancers. Female nu/nu mice implanted with 90-day estrogen pellets were implanted with 6 million T47D human breast cancer cells that had been mixed 50/50 with Matrigel. Mice bearing tumors that were at least 150 mm³ and had three successive increases in tumor volume were selected for treatment. Animals were injected sub-cutaneously twice per week with 80 mg/kg MN-E6 Fab and an equal number of mice fitting the same selection criteria were injected with vehicle alone (FIG. 7A).

In another aspect, MN-E6 was shown to halt the growth of prostate cancer. FIG. 7B shows that MN-E6 Fab potently inhibited the growth of MUC1* positive prostate cancers. Male NOD/SCID mice were implanted with 6 million DU-145 human prostate cancer cells that had been mixed 50/50 with Matrigel. Mice bearing tumors that were at least 150 mm^3 and had three successive increases in tumor volume were selected for treatment. Animals were injected sub-cutaneously every 48 hours with 160 mg/kg MN-E6 Fab and an equal number of mice fitting the same selection criteria were injected with vehicle alone (FIG. 7B). Tumors were measured independently by two researchers twice per week and recorded. Statistics were blindly calculated by independent statistician, giving a P value of 0.0001 for each. Anti-MUC1* Fab inhibited breast cancer growth and prostate cancer growth. Treatment had no effect on weight, bone marrow cell type or number. The MN-E6 Fab effectively inhibited the growth of the tumors, while the control group's tumors continued to grow until sacrifice. No adverse effects of treatment were observed or detected.

Recombinant forms of MN-E6 and MNC2 were constructed that like the Fab are monomeric. In this case, MN-E6 was humanized and MN-C2 was humanized. There are a number of methods known to those skilled in the art for humanizing antibodies. In addition to humanizing, libraries of human antibodies can be screened to identify other fully human antibodies that bind to the PSMGFR.

A single chain of the humanized MN-E6 variable region, called an scFv, was genetically engineered such that it was connected to the Fc portion of the antibody (SEQ ID NO: 256 and 257). Fc regions impart certain benefits to antibody fragments for use as therapeutics. The Fc portion of an antibody recruits complement, which in general means it can recruit other aspects of the immune system and thus amplify the anti-tumor response beyond just inhibiting the target. The addition of the Fc portion also increases the half-life of the antibody fragment (Czajkowsky D M, Hu J, Shao Z and Pleass R J. (2012) Fc-fusion proteins: new developments and future perspectives. EMBO Mol Med. 4 (10): 1015-1028). However, the Fc portion of an antibody homo-dimerizes, which in the case of anti-MUC1* antibody based therapeutics is not optimal since ligand-induced dimerization of the MUC1* receptor stimulates growth. Therefore, mutations in the Fc region that resist dimer formation are preferred for anti-MUC1* anti-cancer therapeutics. Deletion of the hinge region and other mutations in the Fc region that make the Fc-mutant resistant to dimerization were made and could be used as therapeutics.

A human or humanized MN-E6 antibody or antibody fragment, Fab, MN-E6 scFv or hu MN-E6 scFv-Fc$_{mut}$ are effective anti-cancer agents that can be administered to a person diagnosed with a MUC1 or MUC1* positive cancer, suspected of having a MUC1 or MUC1* positive cancer or is at risk of developing a MUC1 or MUC1* positive cancer.

Humanizing

Humanized antibodies or antibody fragments or fully human antibodies that bind to the extracellular domain of –MUC1* are preferred for therapeutic use. The techniques described herein for humanizing antibodies are but a few of a variety of methods known to those skilled in the art. The invention is not meant to be limited by the technique used to humanize the antibody.

Humanization is the process of replacing the non-human regions of a therapeutic antibody (usually mouse monoclonal antibody) by human one without changing its binding specificity and affinity. The main goal of humanization is to reduce immunogenicity of the therapeutic monoclonal antibody when administered to human. Three distinct types of humanization are possible. First, a chimeric antibody is made by replacing the non-human constant region of the antibody by the human constant region. Such antibody will contain the mouse Fab region and will contain about 80-90% of human sequence. Second, a humanized antibody is made by grafting of the mouse CDR regions (responsible of the binding specificity) onto the variable region of a human antibody, replacing the human CDR (CDR-grafting method). Such antibody will contain about 90-95% of human sequence. Third and last, a full human antibody (100% human sequence) can be created by phage display, where a library of human antibodies is screened to select antigen specific human antibody or by immunizing transgenic mice expressing human antibody.

A general technique for humanizing an antibody is practiced approximately as follows. Monoclonal antibodies are generated in a host animal, typically in mice. Monoclonal antibodies are then screened for affinity and specificity of binding to the target. Once a monoclonal antibody that has the desired effect and desired characteristics is identified, it is sequenced. The sequence of the animal-generated antibody is then aligned with the sequences of many human antibodies in order to find human antibodies with sequences that are the most homologous to the animal antibody. Biochemistry techniques are employed to paste together the human antibody sequences and the animal antibody sequences. Typically, the non-human CDRs are grafted into the human antibodies that have the highest homology to the non-human antibody. This process can generate many candidate humanized antibodies that need to be tested to identify which antibody or antibodies has the desired affinity and specificity.

Once a human antibody or a humanized antibody has been generated it can be further modified for use as an Fab fragment, as a full antibody, or as an antibody-like entity such as a single chain molecule containing the variable regions, such as scFv or an scFv-Fc. In some cases it is desirable to have Fc region of the antibody or antibody-like molecule mutated such that it does not dimerize.

In addition to methods that introduce human sequences into antibodies generated in non-human species, fully human antibodies can be obtained by screening human antibody libraries with a peptide fragment of an antigen. A fully human antibody that functions like MN-E6 or MN-C2 is generated by screening a human antibody library with a peptide having the sequence of the PSMGFR N-10 peptide. Humanized anti-MUC1* antibodies were generated based on the sequences of the mouse monoclonal antibodies MN-E6 and MN-C2. In one aspect of the invention, a patient diagnosed with a MUC1* positive cancer is treated with an effective amount of a murine or camelid MNC2, MNE6, 20A10 (SEQ ID NOS: 1574-1581), 3C2B1 (SEQ ID NOS: 1572-1573), 5C6F3, 25E6 (SEQ ID NO:1598-1601), 18G12, 28F9, 1E4, B12, B2, B7, B9, 8C7F3, or H11. In another aspect of the invention, a patient diagnosed with a MUC1* positive cancer is treated with an effective amount of humanized MN-E6 or MN-C2. In a preferred embodiment, a patient diagnosed with a MUC1* positive cancer is treated with an effective amount of humanized MNC2, MNE6, 20A10, 3C2B1, 5C6F3, 25E6, 18G12, 28F9, 1E4, B12, B2, B7, B9, 8C7F3, or H11. In another aspect of the invention, a patient diagnosed with a MUC1* positive cancer is treated with an effective amount of humanized monovalent MNC2, MNE6, 20A10 (SEQ ID NOS: 1574-1581), 3C2B1, 5C6F3, 25E6, 18G12, 28F9, 1E4, B12, B2, B7, B9, 8C7F3, or H11, wherein monovalent means the corresponding Fab fragment, the corresponding scFv or the corresponding scFv-Fc fusion. In a preferred embodiment, a patient diagnosed with a MUC1* positive cancer is treated with an effective amount of a humanized scFv or monomeric humanized scFv-Fc of MNC2, MNE6, 20A10, 3C2B1, 5C6F3, 25E6, 18G12, 28F9, 1E4, B12, B2, B7, B9, 8C7F3, or H11. Since the MUC1* growth factor receptor is activated by ligand induced dimerization of its extracellular domain, and because the Fc portion of an antibody homo-dimerizes, it is preferable that a construct that includes an Fc portion uses a mutated Fc region that prevents or minimizes dimerization.

Antibodies that bind to PSMGFR (SEQ ID NO:2) peptide, and more specifically to the N-10 peptide, of the extracellular domain of the MUC1* receptor are potent anti-cancer therapeutics that are effective for the treatment or prevention of MUC1* positive cancers. They have been shown to inhibit the binding of activating ligands dimeric NME1 (SEQ ID NO:1781) and NME7$_{AB}$ (SEQ ID NOS: 827) to the extracellular domain of MUC1*. Anti-MUC1* antibodies that bind to the PSMGFR sequence inhibit the growth of MUC1*-positive cancer cells, specifically if they inhibit ligand-induced receptor dimerization. Fabs of anti-MUC1* antibodies have been demonstrated to block tumor growth in animals. Thus, antibodies or antibody fragments that bind to the extracellular domain of MUC1* would be beneficial for the treatment of cancers wherein the cancerous tissues express MUC1*.

Antibodies that bind to PSMGFR region of MUC1* or bind to a synthetic PSMGFR peptide are preferred. We have identified several monoclonal antibodies that bind to the extracellular domain of MUC1*. Among this group are mouse monoclonal antibodies MNC2 (SEQ ID NOS: 118-131, 144-158, 163-164, 168-181, 194-209), MNE6 (SEQ ID NOS: 12-25, 39-59, 65-78, 93-114), 20A10 (SEQ ID NOS: 988-1019, 1574-1597, 1659-1666); 3C2B1 (SEQ ID NOS: 1386-1413, 1572-1573), 5C6F3 (SEQ ID NOS: 1356-1385), 25E6 (SEQ ID NOS: 1020-1051, 1598-1617, 1667-1674), 18G12 (SEQ ID NOS: 956-987), 28F9 (SEQ ID NOS: 1052-1083), 1E4 (SEQ ID NOS: 1116-1227), B12 (SEQ ID NOS: 1414-1431, 1733-1742), B2 (SEQ ID NOS: 1432-1459), B7 (SEQ ID NOS: 1460-1487), B9 SEQ ID NOS: 1544-1571), 8C7F3 (SEQ ID NOS: 1488-1515), or H11 (SEQ ID NOS: 1516-1543), the variable regions of which were sequenced and are given as for MN-E6 SEQ ID NOS: 12-13 and 65-66, for MN-C2 SEQ ID NOS: 118-119 and 168-169. The CDRs of these antibodies make up the recognition units of the antibodies and are the most important parts of the mouse antibody that should be retained when grafting into a human antibody. The sequences of the CDRs for each mouse monoclonal are as follows, heavy chain sequence followed by light chain: MN-E6 CDR1 (SEQ ID NO:16-17 and 69-70) CDR2 (SEQ ID NO:20-21 and 73-74) CDR3 (SEQ ID NO: 24-25 and 77-78), MN-C2 CDR1 (SEQ ID NO:122-123 and 172-173) CDR2 (SEQ ID NO:126-127 and 176-177) CDR3 (SEQ ID NO:130-131 and 180-181). In some cases, portions of the framework regions that by modeling are thought to be important for the 3-dimensional structure of the CDRs, are also imported from the mouse sequence.

Monoclonal antibodies MN-E6 and MN-C2 have greater affinity for MUC1* as it appears on cancer cells. Monoclonal antibodies MN-C3 and MN-C8 have greater affinity for MUC1* as it appears on stem cells.

All four antibodies have been humanized, which process has resulted in several humanized forms of each antibody. CDRs derived from the variable regions of the mouse antibodies were biochemically grafted into a homologous human antibody variable region sequence. Humanized variable regions of MN-E6 (SEQ ID NOS: 38-39 and 93-94), MN-C2 (SEQ ID NOS: 144-145 and 194-195), MN-C3 (SEQ ID NOS: 439-440 and 486-487) and MN-C8 (SEQ ID NOS: 525-526 and 543-544) were generated by grafting the mouse CDRs into the variable region of a homologous human antibody. The humanized heavy chain variable constructs were then fused into constant regions of either human IgG1 heavy chain constant region (SEQ ID NOS: 58-59) or human IgG2 heavy chain constant region (SEQ ID NO:54-55), which are then paired with either humanized light chain variable constructs fused to a human kappa chain (SEQ ID NO: 109-110) or human lambda chain (SEQ ID NO: 113-114) constant region. Other IgG isotypes could be used as constant region including IgG3 or IgG4.

Examples of humanized MN-E6 variable region into an IgG2 heavy chain (SEQ ID NOS: 52-53) and into an IgG1 heavy chain (SEQ ID NOS: 56-57), humanized MN-C2 variable into an IgG1 heavy chain (SEQ ID NOS: 157-158) or into an IgG2 heavy chain (SEQ ID NOS: 163-164) paired with either Lambda light chain (SEQ ID NO: 111-112 and 216-219) or Kappa chain (SEQ ID NO:107-108 and 210-213) and, humanized MN-C3 (SEQ ID NOS: 455-456, 453-454 and 500-501, 502-503) and MN-C8 (SEQ ID NOS: 541-542, 539-540 and 579-580, 581-582) antibodies were generated. Which IgG constant region is fused to the humanized variable region depends on the desired effect since each isotype has its own characteristic activity. The isotype of the human constant region is selected on the basis of things such as whether antibody dependent cell cytotoxicity (ADCC) or complement dependent cytotoxicity (CDC) is desired but can also depend on the yield of antibody that is generated in cell-based protein expression systems. In a preferred embodiment, humanized anti-MUC1* antibodies or antibody fragments are administered to a person diagnosed with or at risk of developing a MUC1-positive cancer.

One method for testing and selecting the humanized anti-MUC1* antibodies that would be most useful for the treatment of persons with cancer or at risk of developing cancers is to test them for their ability to inhibit the binding of activating ligands to the MUC1* extracellular domain. Dimeric NME1 can bind to and dimerize the MUC1* extracellular domain and in so doing stimulates cancer cell growth. Antibodies and antibody fragments that compete with NME1 for binding to the MUC1* extracellular domain are therefore anti-cancer agents. NME7$_{AB}$ is another activating ligand of MUC1*. In some cases, it is preferable to identify antibodies that block the binding of NME7, or an NME7$_{AB}$ truncation or cleavage product of NME7-X1, to the MUC1* extracellular domain. Antibodies and antibody fragments that compete with NME7 and NME7 variants for binding to the MUC1* extracellular domain are effective as anti-cancer therapeutics. These antibodies include but are not limited to MNC2, MNE6, 20A10, 3C2B1, 5C6F3, 25E6, 18G12, 28F9, 1E4, B12, B2, B7, B9, 8C7F3, or H11 as well as single chain versions, such as scFv, of these antibodies and humanized version thereof. Other NME proteins also bind to MUC1 or MUC1* including NME6 and NME8. Antibodies that compete with these proteins for binding to MUC1* may also be useful as therapeutics. In a preferred embodiment, murine, camelid, human or humanized anti-MUC1* antibodies or antibody fragments are administered to a person diagnosed with or at risk of developing a MUC1-positive cancer. In a more preferred embodiment, single chain antibody fragments, or monomeric scFv-Fc fusions, derived from humanized sequences of MNC2, MNE6, 20A10, 3C2B1, 5C6F3, 25E6, 18G12, 28F9, 1E4, B12, B2, B7, B9, 8C7F3, or H11 are administered to a person diagnosed with or at risk of developing a MUC1-positive cancer.

Single chain variable fragments, scFv, or other forms that result in a monovalent antibody or antibody-like protein are also useful. In some cases it is desired to prevent dimerization of the MUC1* extracellular domain. Single chain variable fragments, Fabs and other monovalent antibody-like proteins have been shown to be effective in binding to the extracellular domain of MUC1* and blocking MUC1* dimerization. These single chain variable fragments, Fabs and other monovalent antibody-like molecules effectively blocked cancer growth in vitro and in animals xenografted with human MUC1-positive cancer cells. Thus, humanized single chain variable fragments or monovalent anti-MUC1* antibodies or antibody-like molecules would be very effective as an anti-cancer therapeutic. Such humanized single chain antibodies, Fabs and other monovalent antibody-like molecules that bind to the MUC1* extracellular domain or to a PSMGFR peptide are therefore useful as anti-cancer therapeutics. Anti-MUC1* single chain variable fragments are generated by grafting non-human CDRs of antibodies, which bind to extracellular domain of MUC1* or bind to PSMGFR peptide, into a framework of a homologous variable region human antibody. The resultant humanized heavy and light chain variable regions are then connected to each other via a suitable linker, wherein the linker should be flexible and of length that it allows heavy chain binding to light chain but discourages heavy chain of one molecule binding to the light chain of another. For example a linker of about 10-15 residues. Preferably, the linker includes [(Glycine)$_4$ (Serine)$_1$]$_3$ (SEQ ID NOS: 401-402), but is not limited to this sequence as other sequences are possible.

In one aspect, the humanized variable regions of MN-E6 (SEQ ID NOS: 38-39 and 93-94), MN-C2 (SEQ ID NOS: 144-145 and 194-195), or other antibodies of the invention are biochemically grafted into a construct that connects heavy and light chains via a linker. Examples of humanized single chain anti-MUC1* antibodies comprising humanized sequences from the variable regions of MN-E6 and MN-C2, were generated. Several humanized MN-E6 single chain proteins were generated (SEQ ID NOS: 232-237). Several humanized MN-C2 single chain proteins were generated (SEQ ID NOS: 238-243). In a preferred embodiment, humanized anti-MUC1* antibody fragments, including variable fragments, scFv antibody fragments MN-E6 scFv, MN-C2 scFv, 20A10, 3C2B1, 5C6F3, 25E6, 18G12, 28F9, 1E4, B12, B2, B7, B9, 8C7F3, or H11 scFv are administered to a person diagnosed with or at risk of developing a MUC1-positive cancer.

One aspect of the invention is a method for treating a patient diagnosed with, suspected of having, or at risk of developing a MUC1 positive or MUC1* positive cancer, wherein the patient is administered an effective amount of a monomeric MN-E6 scFv, MN-C2 scFv, or MN-E6 scFv-Fc, MN-C2 scFv-Fc, 20A10, 3C2B1, 5C6F3, 25E6, 18G12, 28F9, 1E4, B12, B2, B7, B9, 8C7F3, or H11, wherein the antibody variable fragment portions are human or have been humanized and wherein the Fc portion of the antibody-like protein has been mutated such that it resists dimer formation. CAR T and Cancer Immunotherapy Techniques In another aspect of the invention, some or all of the single chain portions of anti-MUC1* antibody fragments are biochemically fused onto immune system molecules, using several different chimeric antigen receptor, 'CAR' strategies. The idea is to fuse the recognition portion of an antibody, typically as a single chain variable fragment, to an immune system molecule that has a transmembrane domain and a cytoplasmic tail that is able to transmit signals that activate the immune system. The recognition unit can be an antibody fragment, a single chain variable fragment, scFv, or a peptide. In one aspect, the recognition portion of the extracellular domain of the CAR is comprised of sequences from the humanized variable region of MN-E6 (SEQ ID NOS: 38-39 and 93-94), MN-C2 (SEQ ID NOS: 144-145 and 194-195), 20A10, 3C2B1, 5C6F3, 25E6, 18G12, 28F9, 1E4, B12, B2, B7, B9, 8C7F3, or H11. Examples of murine or humanized antibodies of the invention, or their single chain fragments, scFv's, which can be incorporated into CARs, BiTEs or ADCs are given as: 3C2B1 (SEQ ID NOS: 1572-1573), 20A10 (SEQ ID NOS: 1574-1581), 25E6 (SEQ ID NOS: 1598-1601). In another aspect, it is comprised of sequences from a single chain variable fragment. Examples of single chain constructs are given. Several humanized MN-E6 single chain proteins, scFv, were generated (SEQ ID NOS: 232-237). Several humanized MN-C2 single chain proteins, scFv, were generated (SEQ ID NOS: 238-243). The transmembrane region of the CAR can be derived from CD8, CD4, antibody domains or other transmembrane region, including the transmembrane region of the proximal cytoplasmic co-stimulatory domain, such as CD28, 4-1BB or other. The cytoplasmic tail of the CAR can be comprised of one or more motifs that signal immune system activation. This group of cytoplasmic signaling motifs, sometimes referred to as, co-stimulatory cytoplasmic domains, includes but is not limited to CD3-zeta, CD27, CD28, 4-1BB, OX40, CD30, CD40, ICAm-1, LFA-1, ICOS, CD2, CD5, CD7 and Fc receptor gamma domain. A minimal CAR may have the CD3-zeta or an Fc receptor gamma domain then one or two of the above domains in tandem on the cytoplasmic tail. In one aspect, the cytoplasmic tail comprises CD3-zeta, CD28, 4-1BB and/or OX40.

The extracellular domain recognition unit of a MUC1* targeting CAR can comprise variable regions of any non-human, humanized or human antibody that is able to bind to at least 12 contiguous amino acids of the PSMGFR peptide (SEQ ID NO:2) or the N-10 peptide. In one aspect, the MUC1* targeting portion of the CAR comprises variable regions from non-human, humanized or human MNC2, MNE6, 20A10, 3C2B1, 5C6F3, 25E6, 18G12, 28F9, 1E4, B12, B2, B7, B9, 8C7F3, or H11. Examples of a few antibodies of the invention, incorporated into CARs as either murine or humanized are given as 20A10 (SEQ ID NOS: 1582-1597) and 25E6 (SEQ ID NOS: 1602-1617). In the humanization process, the antibody CDRs can be inserted into a number of different framework regions; as a demonstration we generated three versions of a humanized 20A10 which differ only in the framework regions. These have been incorporated into CARs (SEQ ID NOS: 1675, 1678, 1685) that when transduced into human T cells are able to recognize target MUC1* expressing cells and kill them. In one aspect, the extracellular domain recognition unit of a CAR is comprised essentially of a humanized MNC2, MNE6, 20A10, 3C2B1, 5C6F3, 25E6, 18G12, 28F9, 1E4, B12, B2, B7, B9, 8C7F3, or H11 single chain variable fragment scFv. The transmembrane region of the CAR can be derived from CD8 (SEQ ID NOS: 363-364), or can be the transmembrane domain of CD3-zeta, CD28, 41bb, OX40 or other transmembrane region (SEQ ID NOS: 361-372) and the cytoplasmic domain of a CAR with antibody fragment targeting MUC1* extracellular domain can be comprised of one or more selected from the group comprising an immune system co-stimulatory cytoplasmic domain. The group of immune system co-stimulatory domains includes but is not limited to CD3-zeta, CD27, CD28, 4-1BB, OX40, CD30, CD40, ICAm-1, LFA-1, ICOS, CD2, CD5, CD7 and Fc receptor gamma domain (SEQ ID NOS: 373-382).

The CARs described can be transfected or transduced into a cell of the immune system. In a preferred embodiment, a MUC1* targeting CAR is transfected or transduced into a T cell. In one aspect, the T cell is a CD3+/CD28+ T cell. In another case it is a dendritic cell. In another case it is a B cell. In another case it is a mast cell. In yet another case it is a Natural Killer, NK, cell. The recipient cell can be from a patient or from a donor. If from a donor, it can be engineered to remove molecules that would trigger rejection. Cells transfected or transduced with a CAR of the invention can be expanded ex vivo or in vitro then administered to a patient. Administrative routes are chosen from a group containing but not limited to bone marrow transplant, intravenous injection, in situ injection or transplant. In a preferred embodiment, the MUC1* targeting CAR is administered to a person diagnosed with or at risk of developing a MUC1-positive cancer.

There are many possible anti-MUC1* CAR constructs that can be transduced into T cells or other immune cells for the treatment or prevention of MUC1* positive cancers. CARs are made up of modules and the identity of some of the modules is relatively unimportant, while the identity of other modules is critically important.

We and others have shown that intracellular signaling modules, such as CD3-zeta (SEQ ID NOS: 373-376), CD28 (SEQ ID NOS: 377-378) and 41BB (SEQ ID NOS: 379-380), alone or in combinations stimulate immune cell expansion, cytokine secretion and immune cell mediated killing of the targeted tumor cells (Pule M A, Straathof K C, Dotti G, Heslop H E, Rooney C M and Brenner M K (2005) A chimeric T cell antigen receptor that augments cytokine release and supports clonal expansion of primary human T cells. Mol Ther. 12 (5): 933-941; Hombach A A, Heiders J, Foppe M, Chmielewski M and Abken H. (2012) OX40 costimulation by a chimeric antigen receptor abrogates CD28 and IL-2 induced IL-10 secretion by redirected CD4 (+) T cells. Oncoimmunology. 1 (4): 458-466; Kowolik C M, Topp M S, Gonzalez S, Pfeiffer T, Olivares S, Gonzalez N, Smith D D, Forman S J, Jensen M C and Cooper L J. (2006) CD28 costimulation provided through a CD19-specific chimeric antigen receptor enhances in vivo persistence and antitumor efficacy of adoptively transferred T cells. Cancer Res. 66 (22): 10995-11004; Loskog A, Giandomenico V, Rossig C, Pule M, Dotti G and Brenner MK. (2006) Addition of the CD28 signaling domain to chimeric T-cell receptors enhances chimeric T-cell resistance to T regulatory cells. Leukemia. 20 (10): 1819-1828; Milone M C, Fish J D, Carpenito C, Carroll R G, Binder G K, Teachey D, Samanta M, Lakhal M, Gloss B, Danet-Desnoyers G, Campana D, Riley J L, Grupp S A and June C H. (2009) Chimeric receptors containing CD137 signal transduction domains mediate enhanced survival of T cells and increased antileukemic efficacy in vivo. Mol Ther. 17 (8): 1453-1464; Song D G, Ye Q, Carpenito C, Poussin M, Wang LP, Ji C, Figini M, June C H, Coukos G, Powell DJ Jr. (2011) In vivo persistence, tumor localization, and antitumor activity of CAR-engineered T cells is enhanced by costimulatory signaling through CD137 (4-1BB). Cancer Res. 71 (13): 4617-4627). Antibodies of the invention including but not limited to fragments of MNC2, MNE6, 20A10, 3C2B1, 5C6F3, 25E6, 18G12, 28F9, 1E4, B12, B2, B7, B9, 8C7F3, or H11 can also be incorporated into CARs that have mutated cytoplasmic tails, such as mutated tyrosines or ITAMs. In any of the CARs described above, the cytoplasmic tails may include mutations that dampen signaling. Such mutations include but are not limited to Tyrosines that are mutated to inhibit phosphorylation and signaling (Salter et al, 2018;). In any of the CARs described above, the ITAMs of CD3-zeta may be mutated to inhibit or dampen signaling (Feucht et al 2019). In any of the CARs described above, the CD3 of the cytoplasmic tail may comprise mutations in the ITAMs including those referred to as 1XX. Examples of antibodies of the invention incorporated into CARs with 1XX mutations in ITAMs of CD3-zeta are given in the following sequences: MNC2 (SEQ ID NOS: 1618-1625), MNE6 (SEQ ID NOS: 1626-1633), 20A10 (SEQ ID NOS: 1590-1595), 25E6 (SEQ ID NOS: 1610-1617). We note that the CDRs of antibodies can be inserted into a background of a number of different framework regions. As an example, 20A10 CDRs were inserted into three different sets of framework regions (SEQ ID NOS: 1692, 1699 and 1706) and all were able to function when transduced into T cells. In any of the CARs described above, the T cell may be engineered to overexpress c-Jun as a method to inhibit T cell exhaustion (Lynn et al 2019). A variety of promoters can be used upstream of the genes for CARs and other compositions of the invention, including insertion into a naturally occurring promoter in the cell, such as the TRAC locus, using CRISPR, Sleeping Beauty or similar technology for site directed insertion of a gene. Among the promoters commonly used are the CMV promoter, or a mini CMV (SEQ ID NO: 1634), a minimal IL-2 promoter (SEQ ID NO: 1635), or Minimal Promoter minip (SEQ ID NO: 1636).

Single chain antibody fragments that included the variable domain of the monoclonal anti-MUC1* antibodies called MN-E6 or MN-C2 were engineered into a panel of CARs. The MUC1* targeting CARs were then transduced, separately or in combinations, into immune cells. When challenged with surfaces presenting a MUC1* peptide, an antigen presenting cell transfected with MUC1*, or MUC1* positive cancer cells, the immune cells that were transduced with MUC1* targeting CARs elicited immune responses, including cytokine release, killing of the targeted cells and expansion of the immune cells.

For example, the gene encoding the CARs and activated T cell induced genes described herein can be virally transduced into an immune cell using viruses, or inserted into a region downstream of one of the cell's promoters or enhancers, such as the TRAC (T cell receptor alpha chain) locus. Virus delivery systems and viral vectors including but not limited to retroviruses, including gamma-retroviruses, lentivirus, adenoviruses, adeno-associated viruses, baculoviruses, poxvirus, herpes simplex viruses, oncolytic viruses, HF10, T-Vec and the like can be used. In addition to viral transduction, CARs and activated T cell induced genes described herein can be directly spliced into the genome of the recipient cell using methods such as CRISPR technology, CRISPR-Cas9 and -CPF1, TALEN, Sleeping Beauty transposon system, and SB 100×.

Similarly, the identity of molecules that make up the non-targeting portions of the CAR such as the extracellular domain, transmembrane domain and membrane proximal portion of the cytoplasmic domain, are not essential to the function of a MUC1*-targeting CAR. For example, the extracellular domain, transmembrane domain and membrane proximal portion of the cytoplasmic domain can be comprised of portions of CD8, CD4, CD28, or generic antibody domains such as Fc, CH2CH3, or CH3. Further, the non-targeting portions of a CAR can be a composite of portions of one or more of these molecules or other family members.

One aspect of the invention is a method for treating a patient diagnosed with, suspected of having, or at risk of developing a MUC1 positive or MUC1* positive cancer, wherein the patient is administered an effective amount of immune cells that have been transduced with a MUC1* targeting CAR. In another aspect of the invention, the immune cells are T cells isolated from a patient, which are then transduced with CARs wherein the targeting head of the CAR binds to MUC1*, and after expansion of transduced T cells, the CAR T cells are administered in an effective amount to the patient. In yet another aspect of the invention, the immune cells are T cells isolated from a patient, which are then transduced with CARs wherein the targeting head of the CAR comprises portions of MNC2, MNE6, 20A10, 3C2B1, 5C6F3, 25E6, 18G12, 28F9, 1E4, B12, B2, B7, B9, 8C7F3, or H11, and after optional expansion of transduced T cells, the CAR T cells are administered in an effective amount to the patient.

Specificity of Anti-MUC1* Targeting Antibodies

As these experiments demonstrate, the critical portion of a CAR is the antibody fragment that directs the immune cell to the tumor cell. As we will show in the following section, MN-E6 and MN-C2 are specific for the form of MUC1* that is expressed on tumor cells. The next most important part of a CAR is the cytoplasmic tail bearing immune system co-stimulatory domains. The identity of these domains modulates the degree of immune response but does not affect the specificity. As shown, the identity of the transmembrane portion of a CAR is the least important. It appears that as long as the transmembrane portion has some flexibility and is long enough to allow the antibody fragment to reach its cognate receptor on the tumor cell, it will suffice. CARs comprising the MN-E6 targeting antibody fragment, and intracellular co-stimulatory domains 41BB and CD3-zeta but having a variety of different extracellular, transmembrane and short cytoplasmic tail all worked in that they specifically killed the targeted cells while stimulating the expansion of the host T cells.

Figures 13A, 13B, 13C, 13D, 13E, 13F:
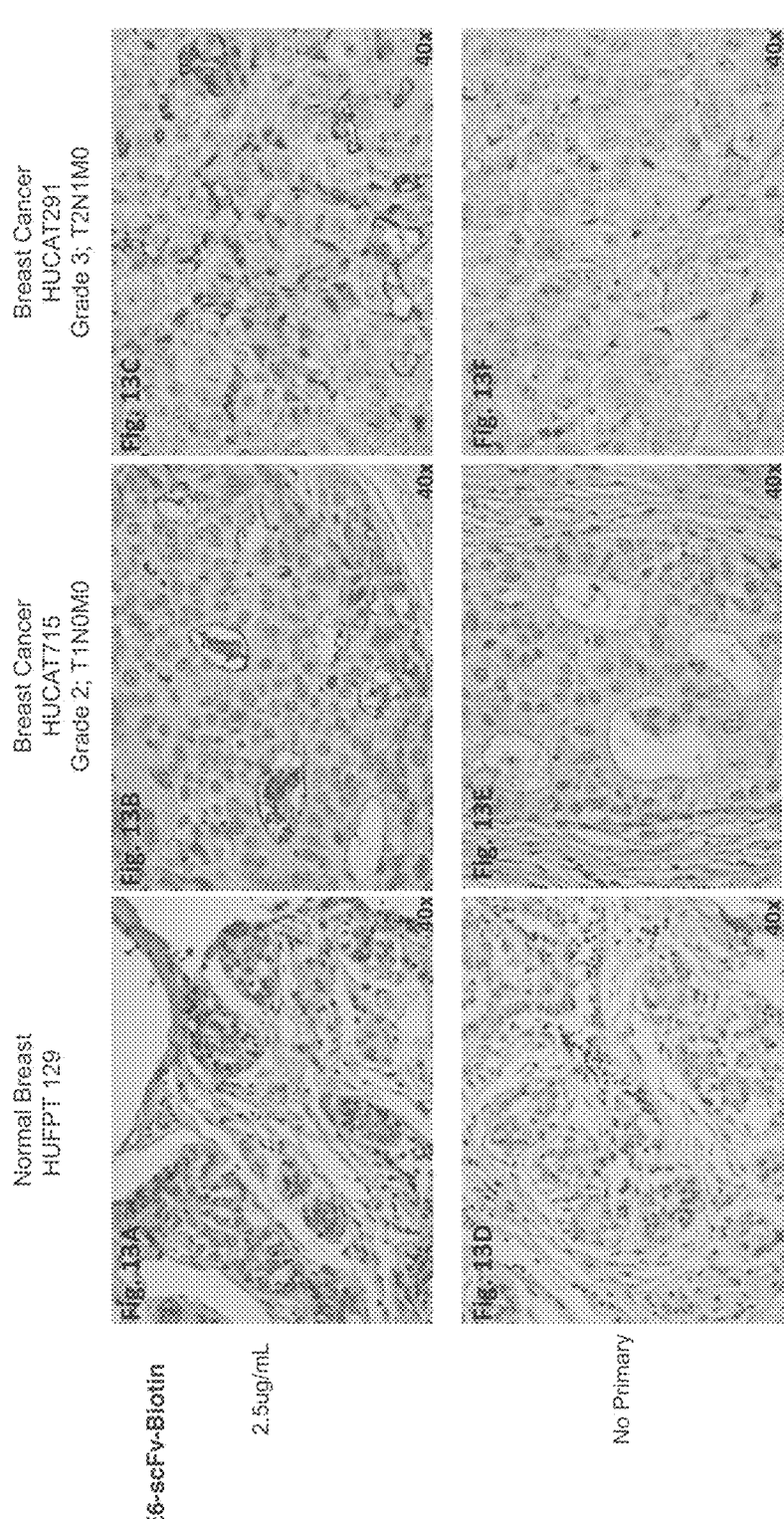
FIGS. 13A-13F show photographs of normal breast and breast cancer tissues stained with humanized MN-E6-scFv-Fc biotinylated anti-MUC1* antibody at 2.5 ug/mL, then stained with a secondary streptavidin HRP antibody.
Figures 14A, 14B, 14C, 14D, 14E, 14F, 14G, 14H:
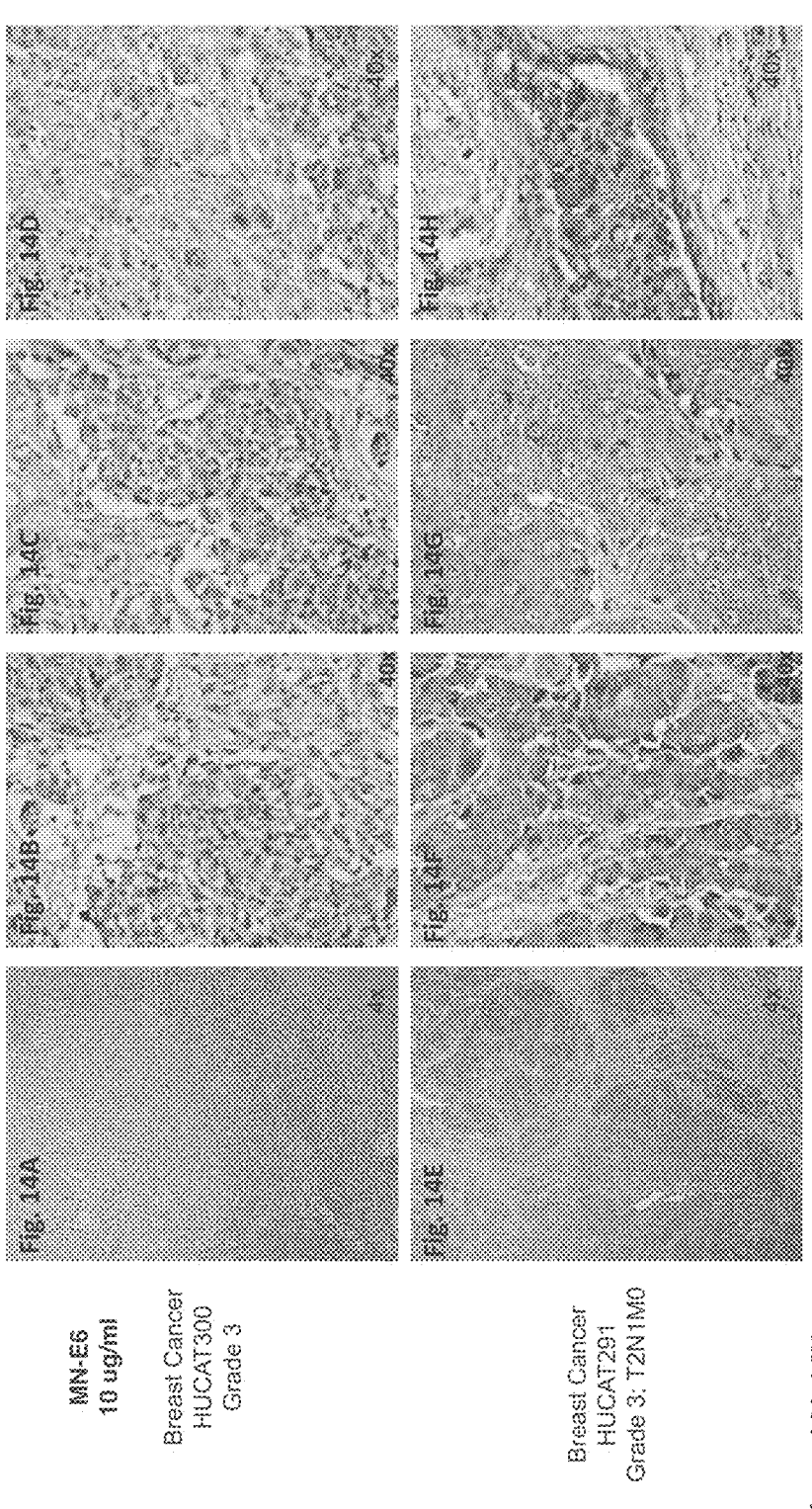
FIGS. 14A-14H show photographs of breast cancer tissues stained with MN-E6 anti-MUC1* antibody at 10 ug/mL, then stained with a rabbit anti mouse secondary HRP antibody.
Figures 15A, 15B, 15C, 15D, 15E, 15F:
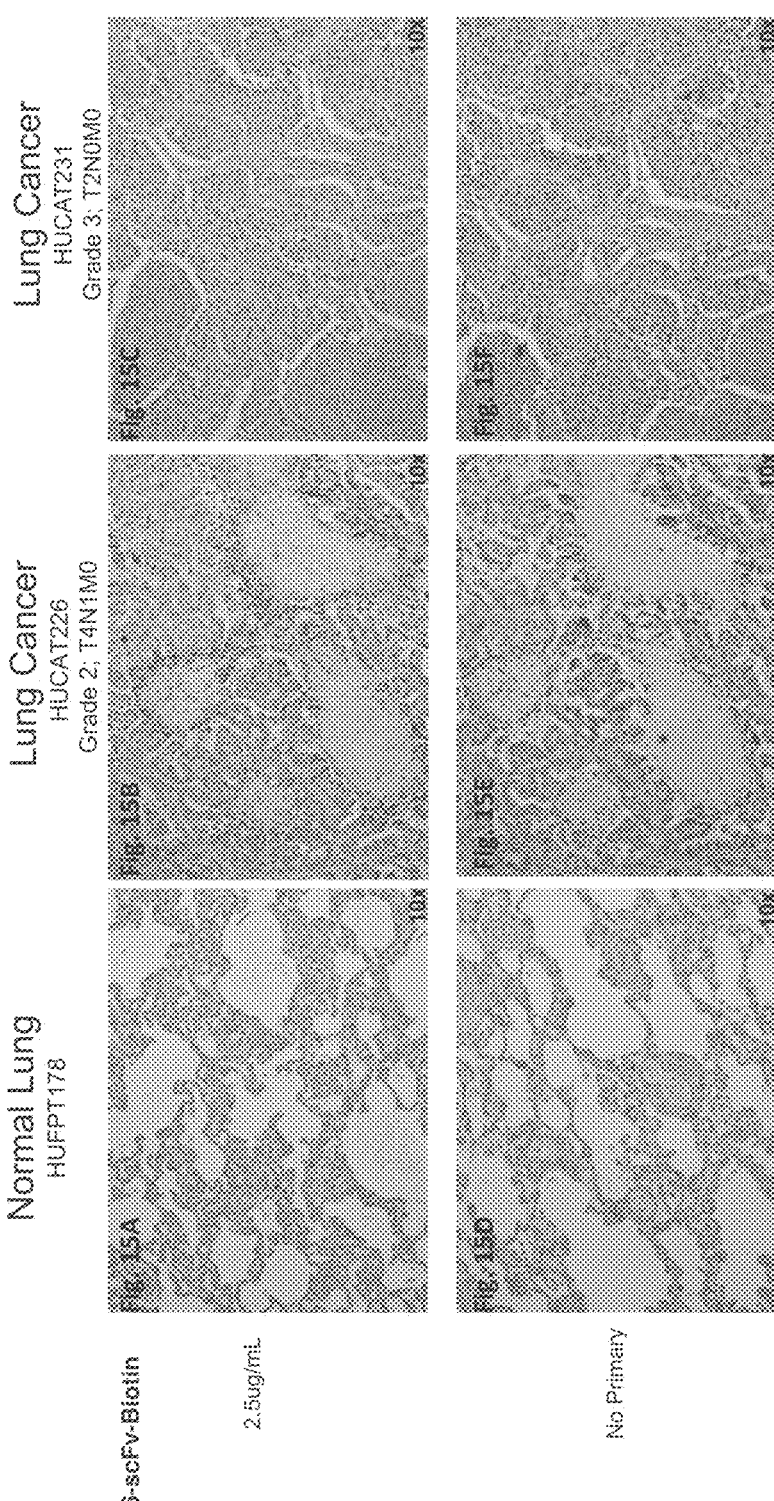
FIGS. 15A-15F show photographs of normal lung and lung cancer tissues stained with humanized MN-E6-scFv-Fc biotinylated anti-MUC1* antibody at 2.5 ug/mL, then stained with a secondary streptavidin HRP antibody.
Figures 16A, 16B, 16C, 16D, 16E, 16F:
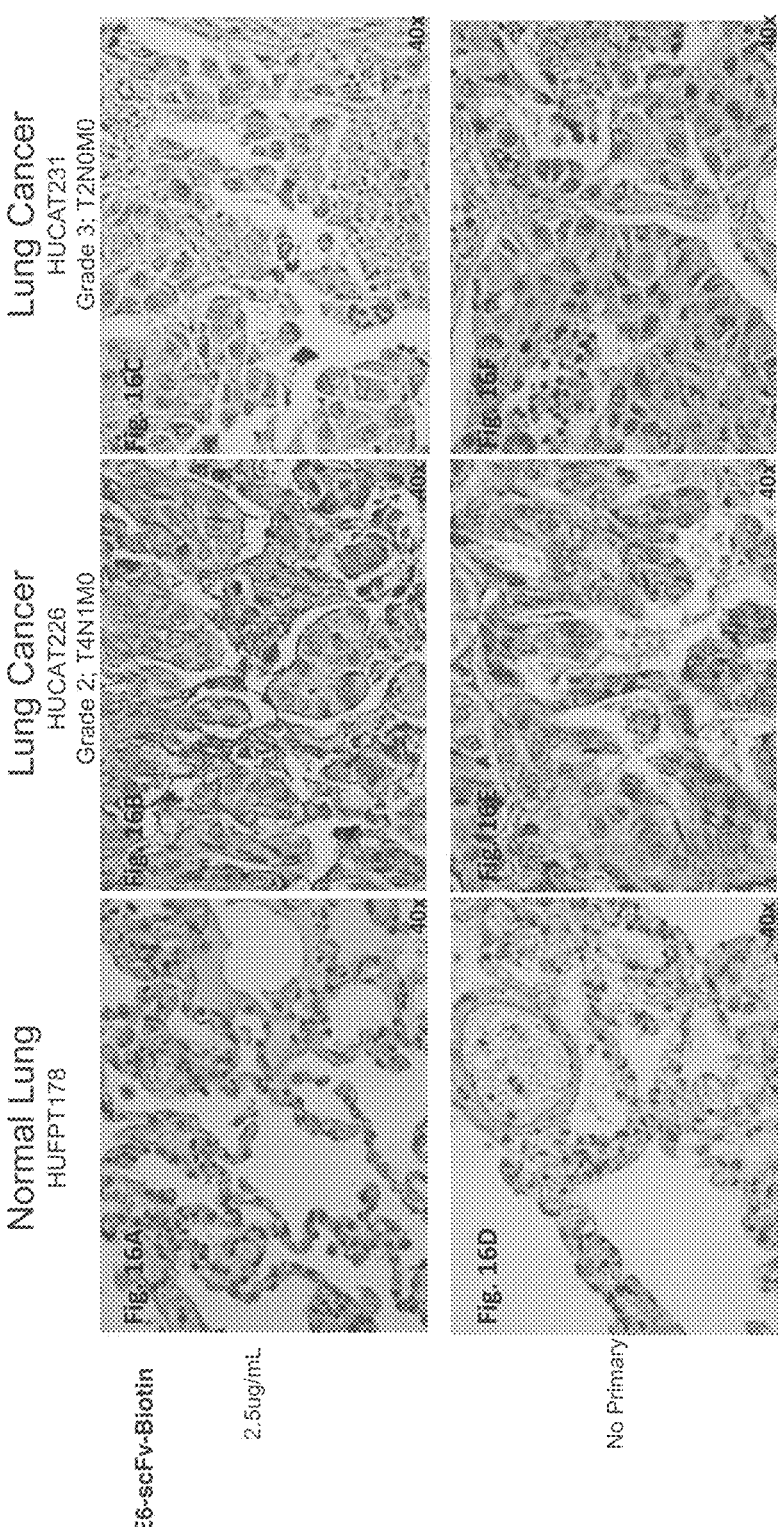
FIGS. 16A-16F show photographs of normal lung and lung cancer tissues stained with humanized MN-E6-scFv-Fc biotinylated anti-MUC1* antibody at 2.5 ug/mL, then stained with a secondary streptavidin HRP antibody.
Figures 17A, 17B, 17C, 17D, 17E, 17F:
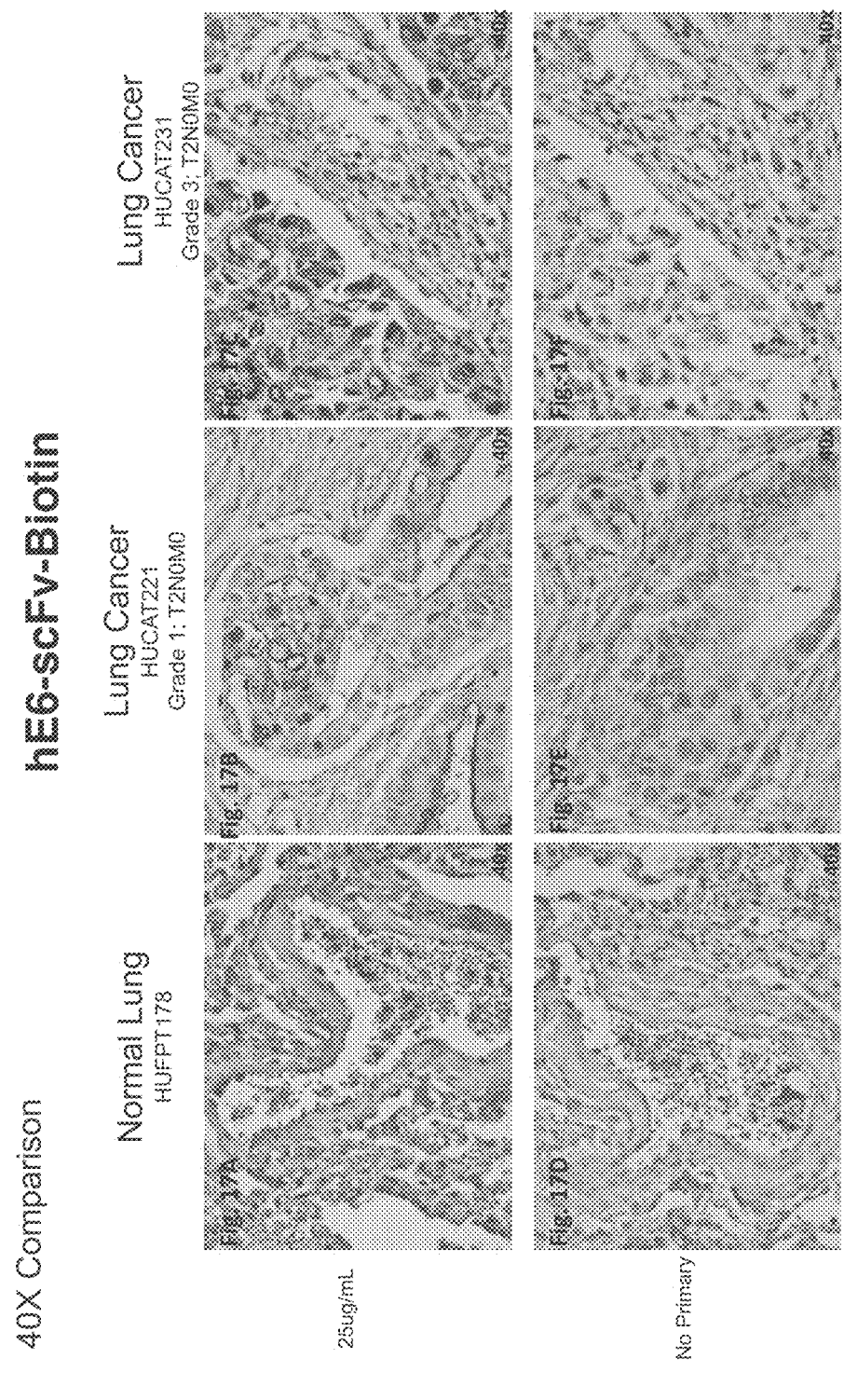
FIGS. 17A-17F show photographs of normal lung and lung cancer tissues stained with humanized MN-E6-scFv-Fc biotinylated anti-MUC1* antibody at 25 ug/mL, then stained with a secondary streptavidin HRP antibody.
Figures 18A, 18B, 18C, 18D, 18E, 18F:
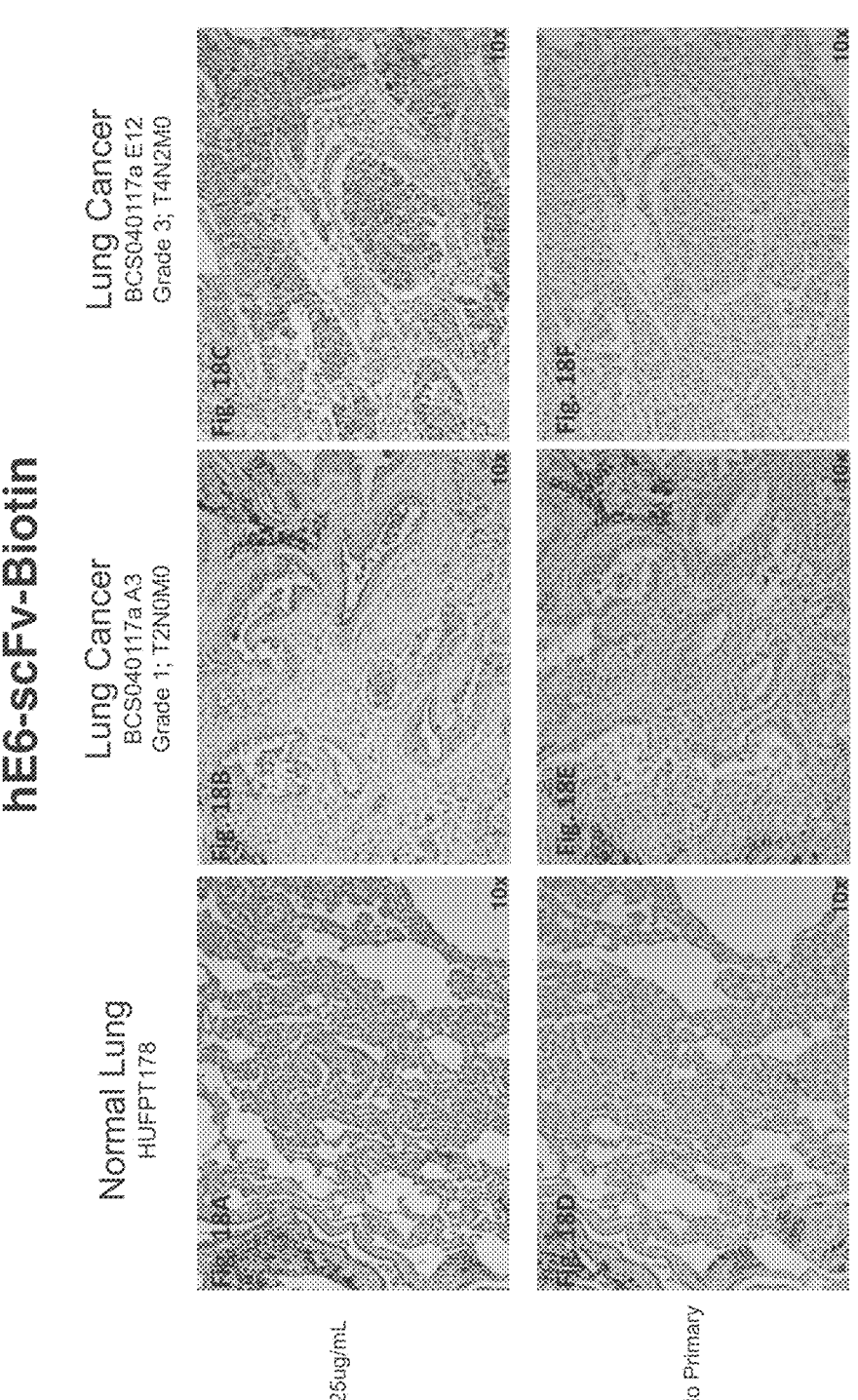
FIGS. 18A-18F show photographs of normal lung and lung cancer tissues stained with humanized MN-E6-scFv-Fc biotinylated anti-MUC1* antibody at 25 ug/mL, then stained with a secondary streptavidin HRP antibody.
Figures 19A, 19B, 19C, 19D:
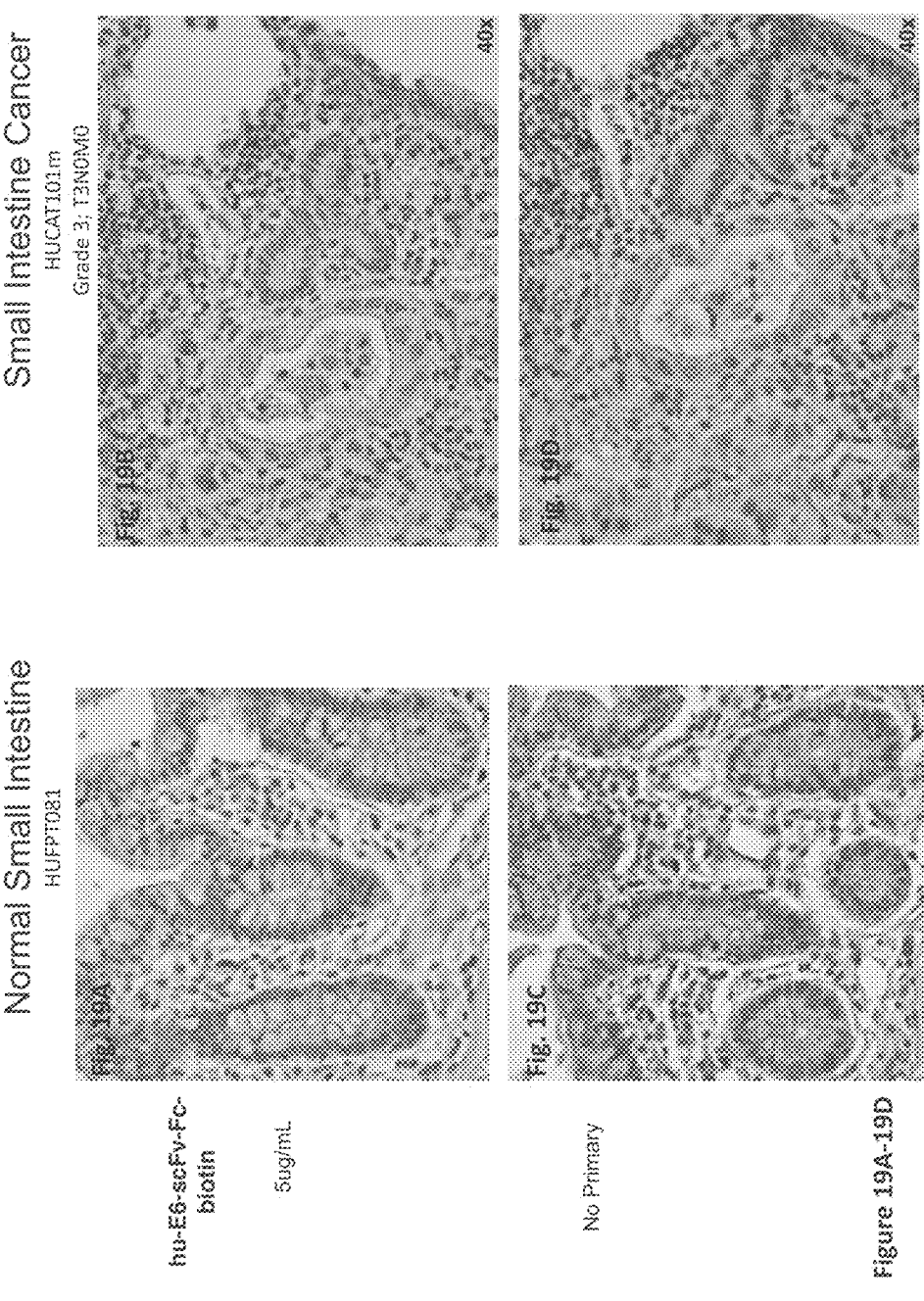
FIGS. 19A-19D show photographs of normal small intestine and cancerous small intestine tissues stained with humanized MN-E6-scFv-Fc biotinylated anti-MUC1* antibody at 5 ug/mL, then stained with a secondary streptavidin HRP antibody.
Figures 21A, 21B, 21C, 21D, 21E, 21F, 21G, 21H:
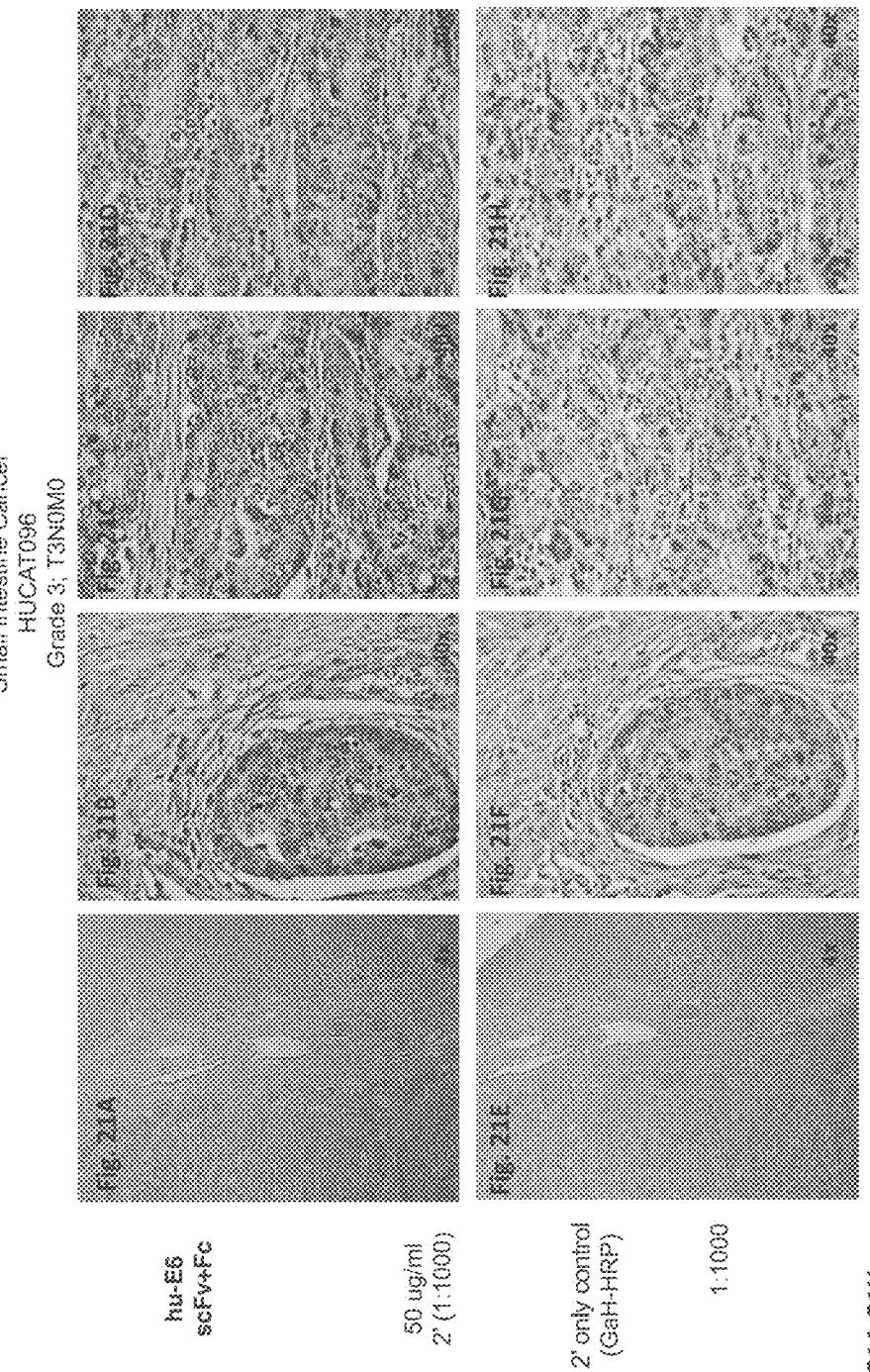
FIGS. 21A-21H show photographs of cancerous small intestine tissues stained with humanized MN-E6-scFv-Fc anti-MUC1* antibody at 50 ug/mL, then stained with a secondary goat-anti-human HRP antibody.
Figures 22A, 22B, 22C, 22D, 22E, 22F, 22G, 22H:
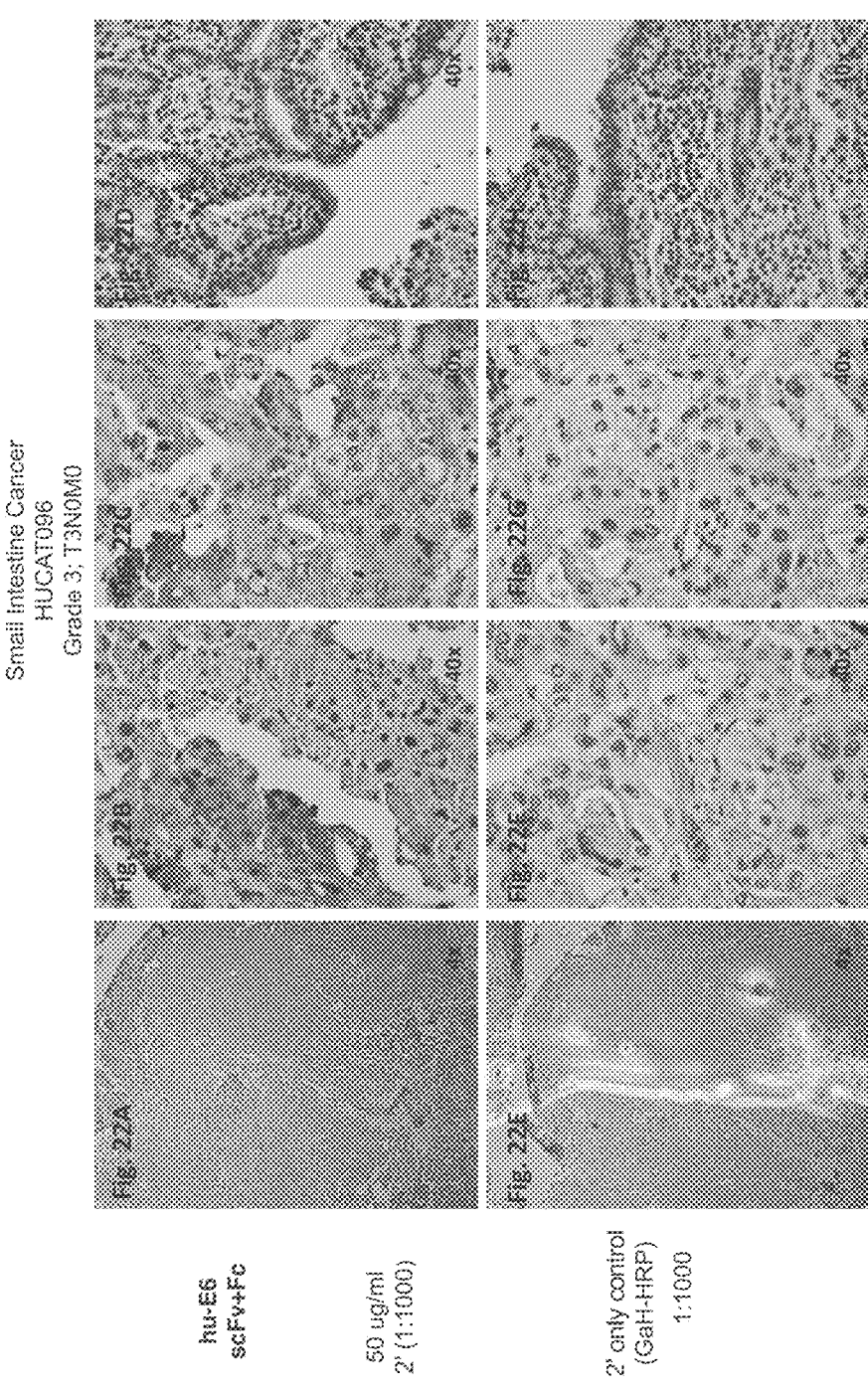
FIGS. 22A-22H show photographs of cancerous small intestine tissues stained with humanized MN-E6-scFv-Fc anti-MUC1* antibody at 50 ug/mL, then stained with a secondary goat-anti-human HRP antibody.
Figures 23A, 23B, 23C, 23D, 23E, 23F, 23G, 23H:
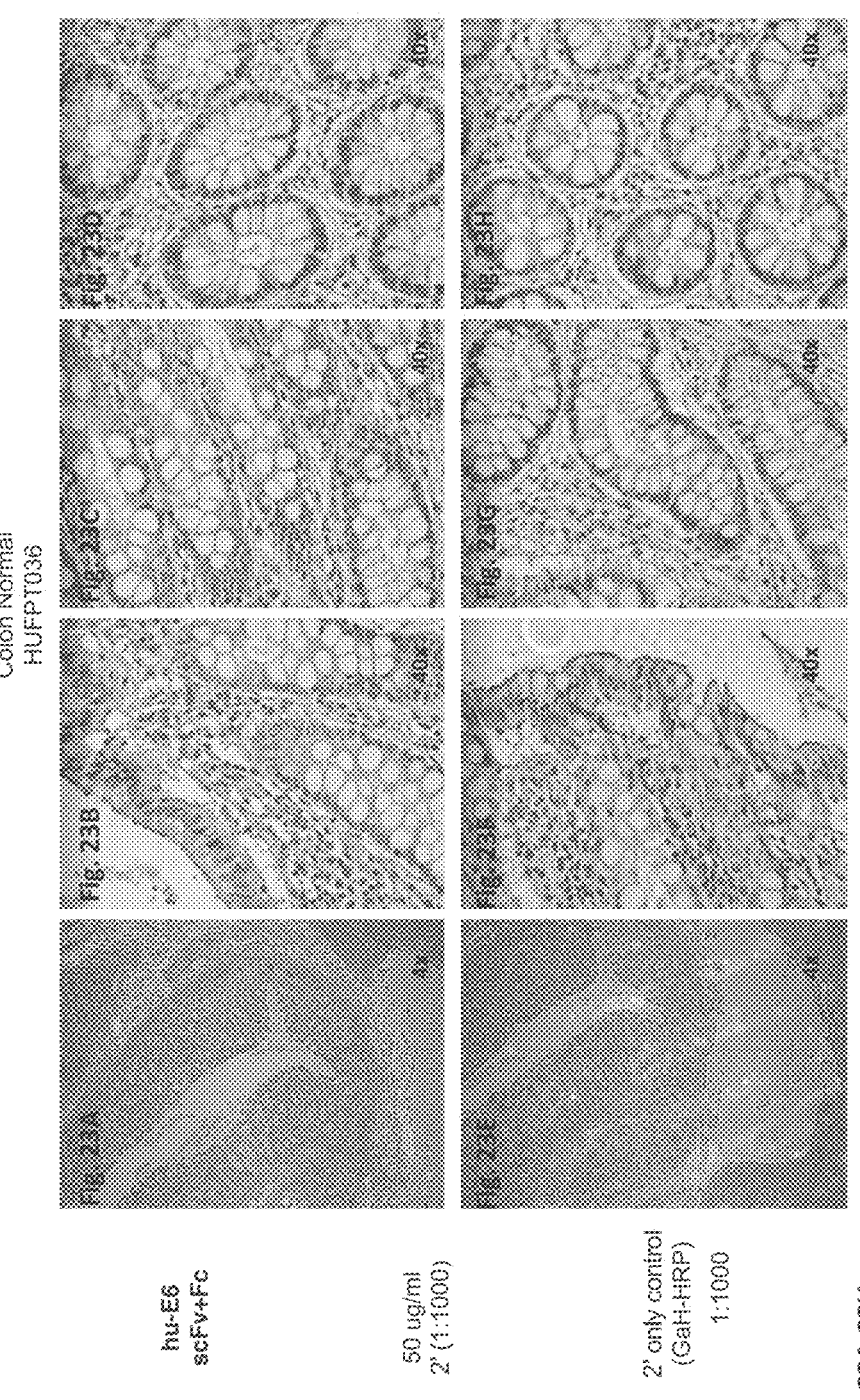
FIGS. 23A-23H show photographs of normal colon tissues stained with humanized MN-E6-scFv-Fc anti-MUC1* antibody at 50 ug/mL, then stained with a secondary goat-anti-human HRP antibody.
Figures 24A, 24B, 24C, 24D, 24E, 24F, 24G, 24H:
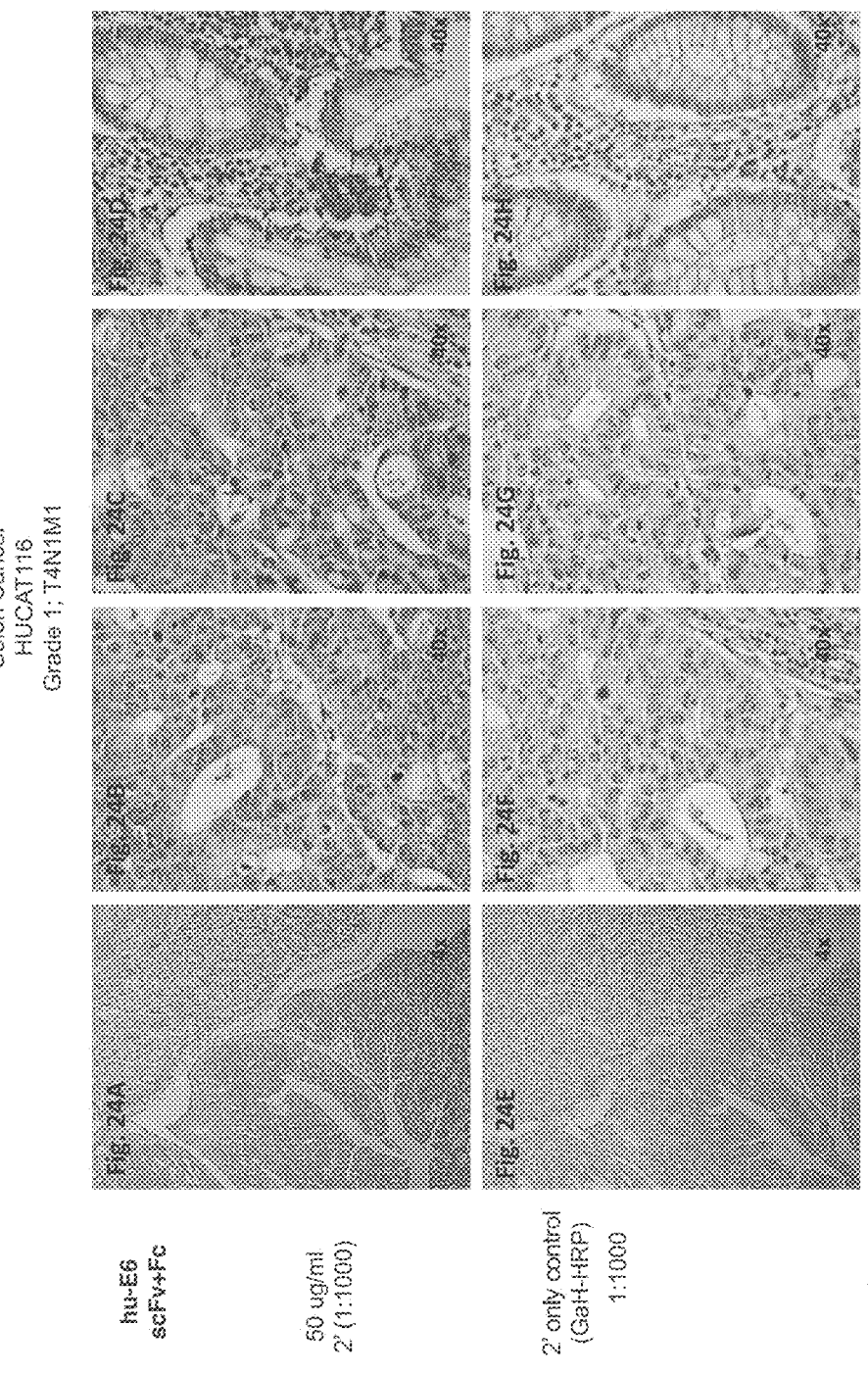
FIGS. 24A-24H show photographs of colon cancer tissues stained with humanized MN-E6-scFv-Fc anti-MUC1* antibody at 50 ug/mL, then stained with a secondary goat-anti-human HRP antibody.
Figures 25A, 25B, 25C, 25D, 25E, 25F, 25G, 25H:
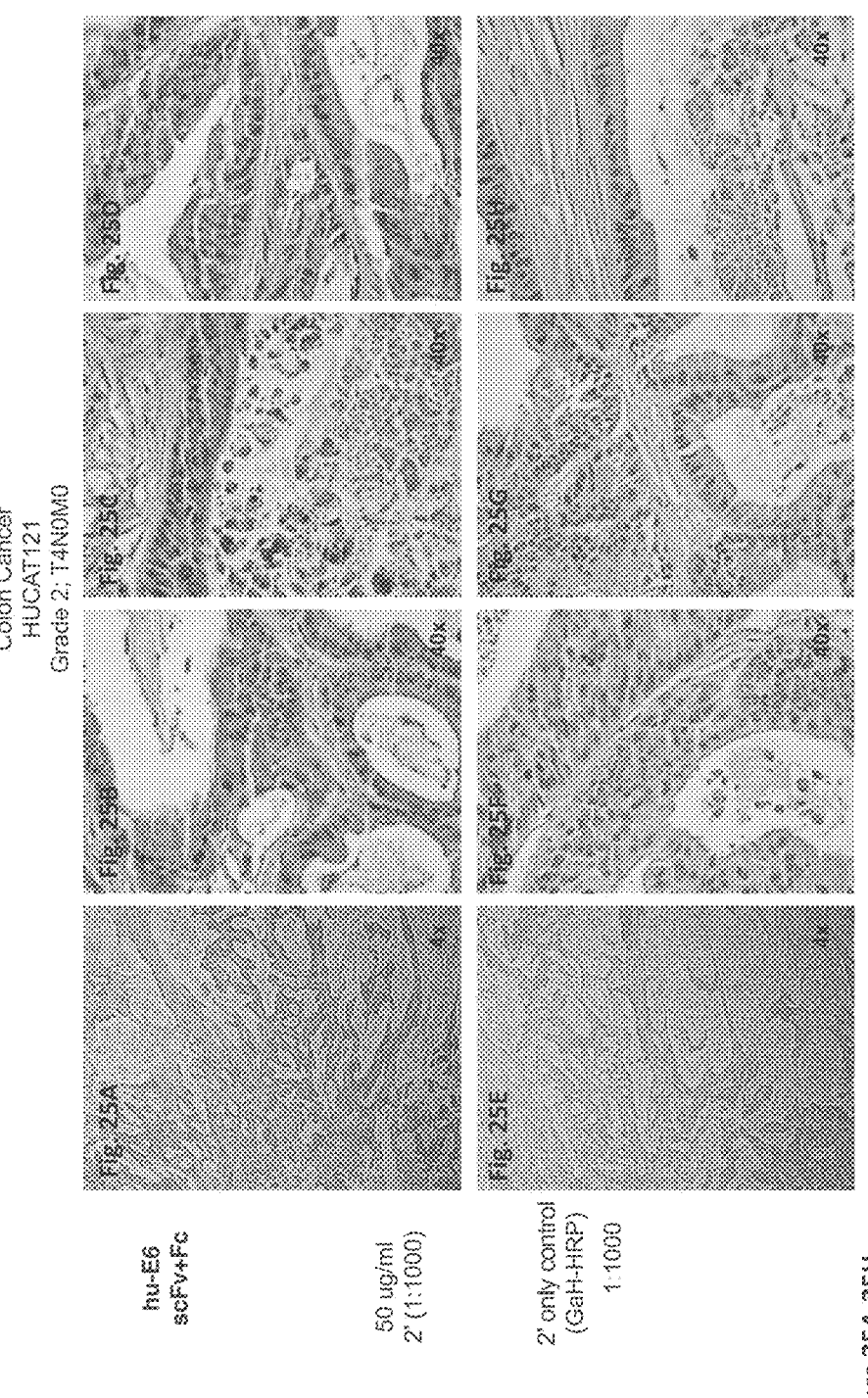
FIGS. 25A-25H show photographs of colon cancer tissues stained with humanized MN-E6-scFv-Fc anti-MUC1* antibody at 50 ug/mL, then stained with a secondary goat-anti-human HRP antibody.
Figures 26A, 26B, 26C, 26D, 26E, 26F, 26G, 26H:
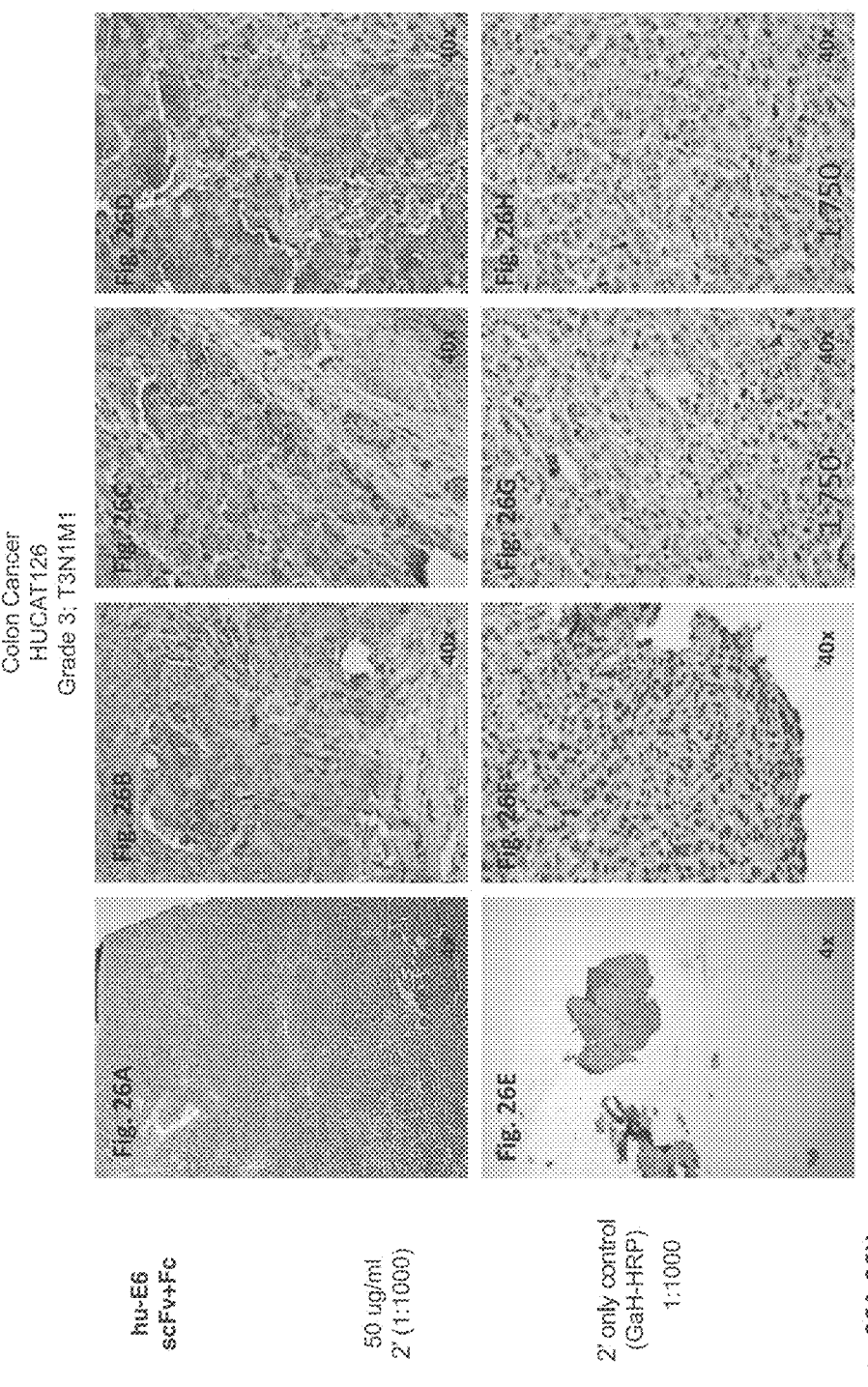
FIGS. 26A-26H show photographs of colon cancer tissues stained with humanized MN-E6-scFv-Fc anti-MUC1* antibody at 50 ug/mL, then stained with a secondary goat-anti-human HRP antibody.
Figures 27A, 27B, 27C, 27D, 27E, 27F, 27G, 27H:
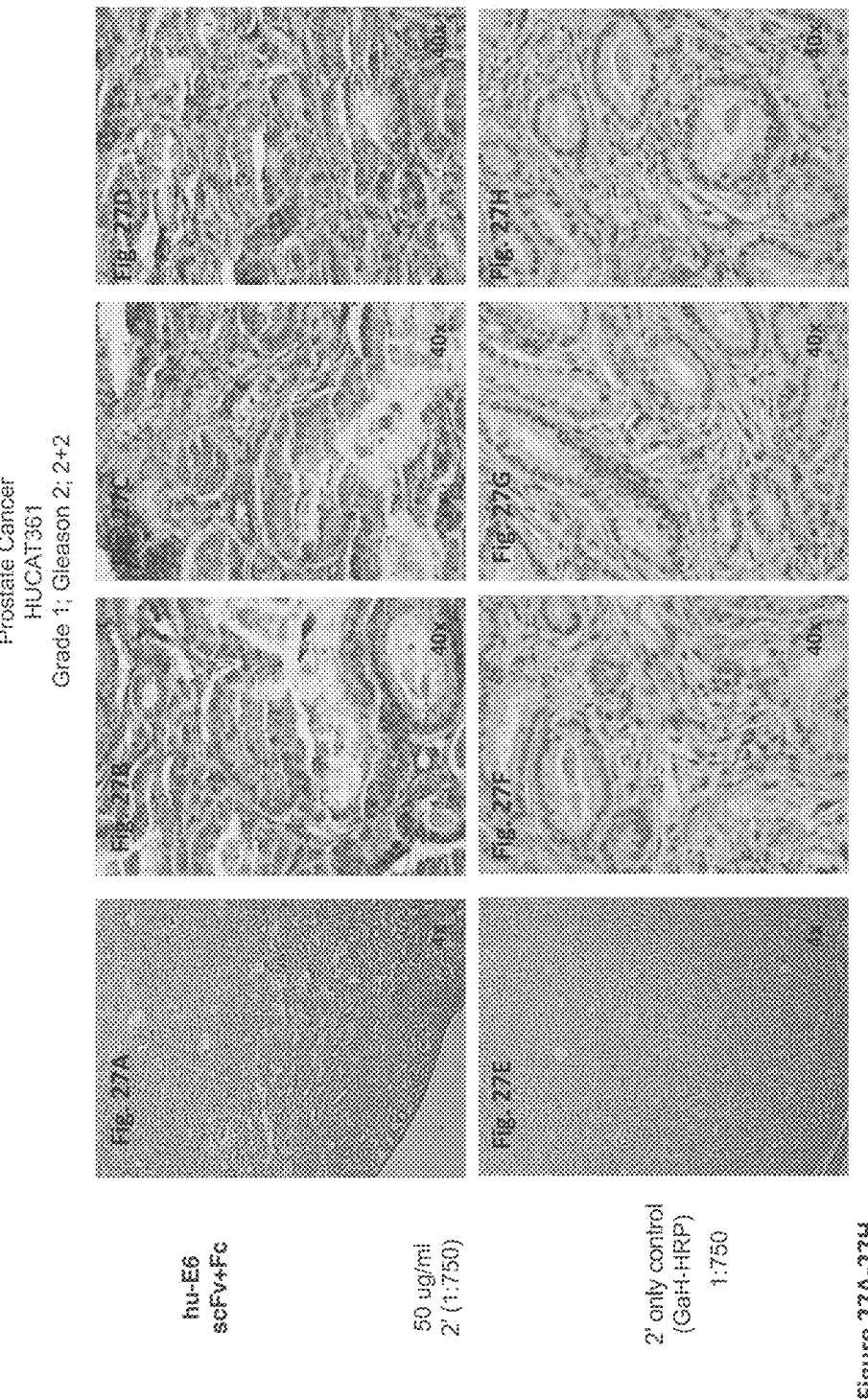
FIGS. 27A-27H show photographs of prostate cancer tissues stained with humanized MN-E6-scFv-Fc anti-MUC1* antibody at 50 ug/mL, then stained with a secondary goat-anti-human HRP antibody.
Figures 28A, 28B, 28C, 28D, 28E, 28F, 28G, 28H:
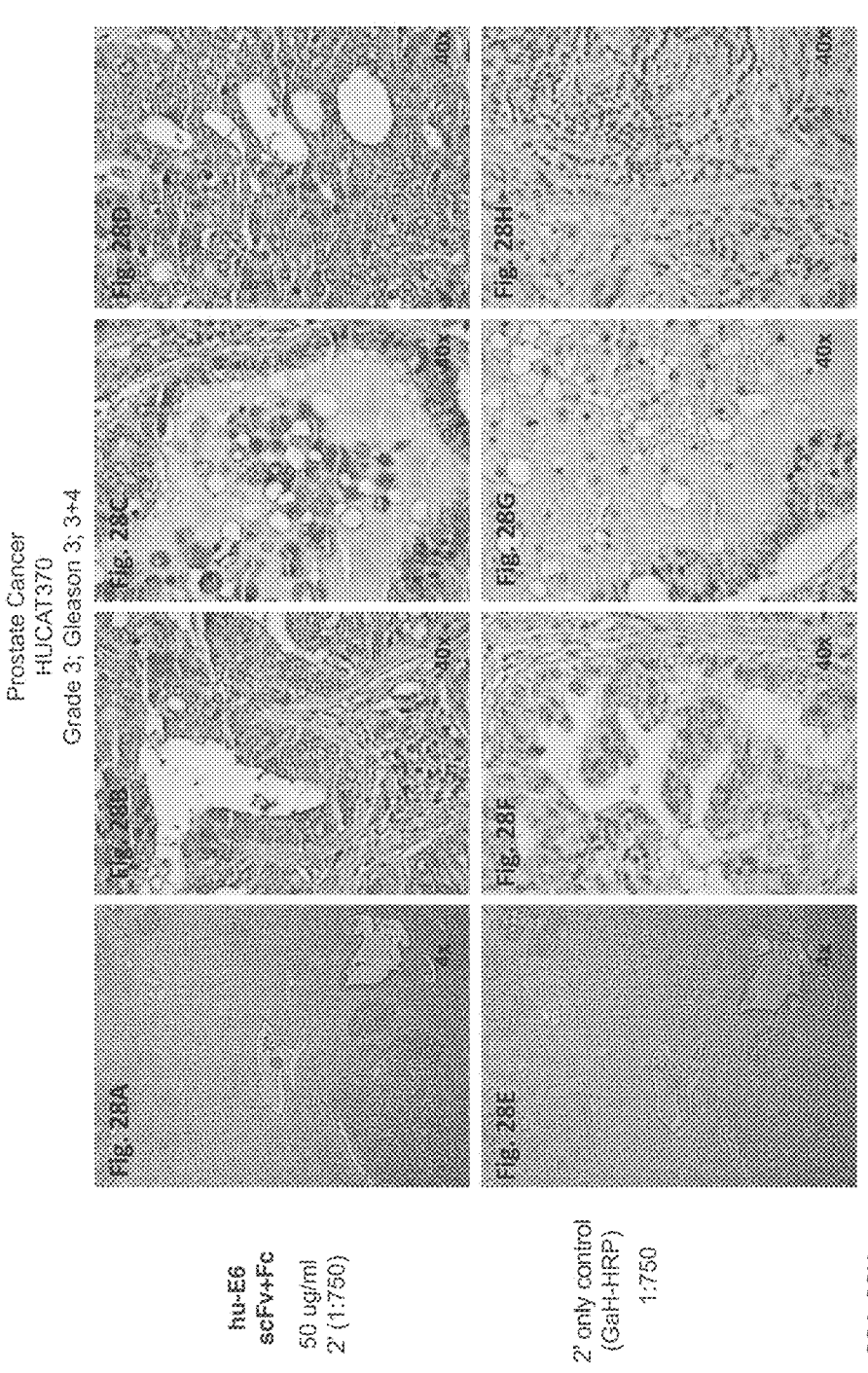
FIGS. 28A-28H show photographs of prostate cancer tissues stained with humanized MN-E6-scFv-Fc anti-MUC1* antibody at 50 ug/mL, then stained with a secondary goat-anti-human HRP antibody.
Figures 29A, 29B, 29C, 29D, 29E, 29F, 29G, 29H:
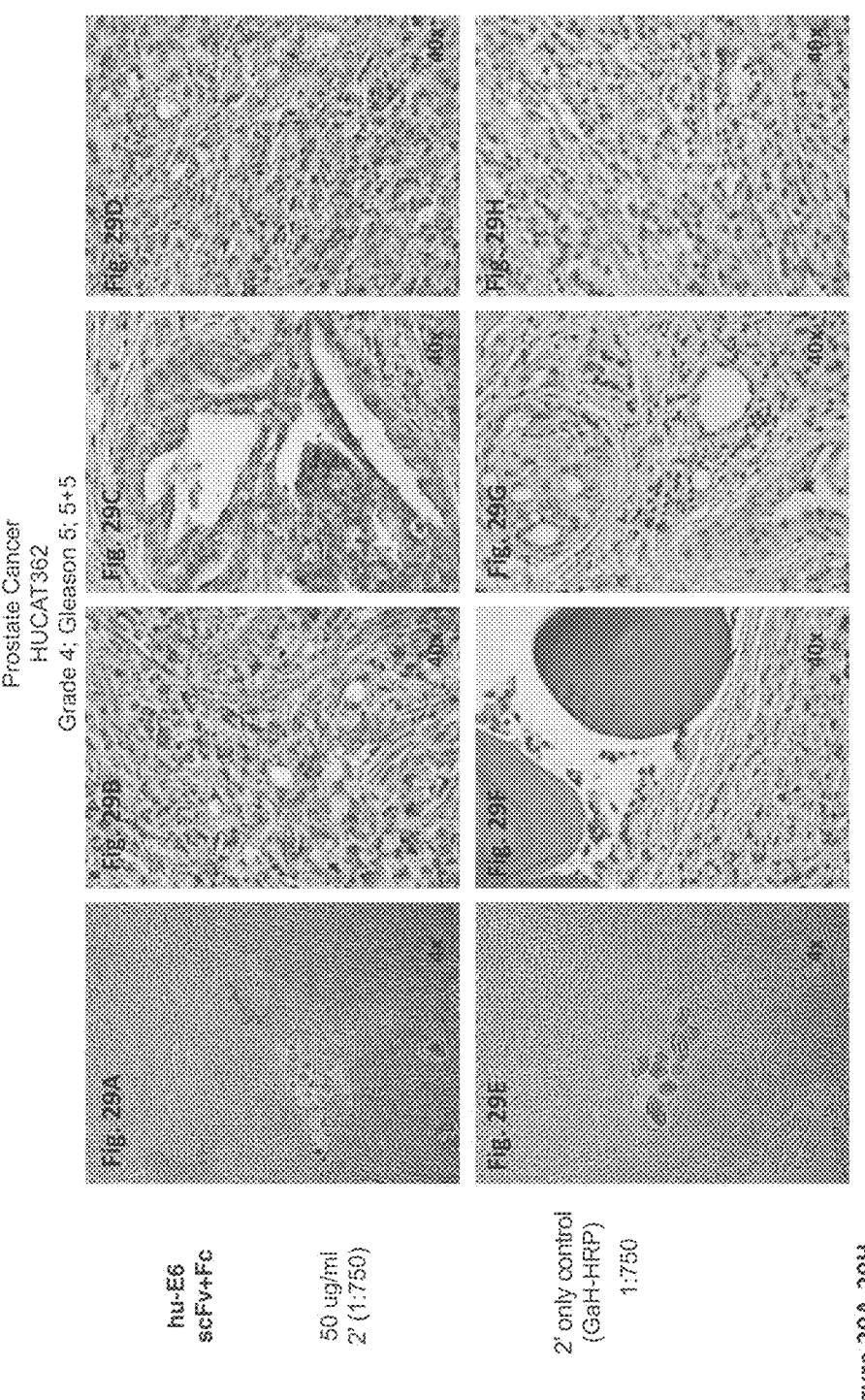
FIGS. 29A-29H show photographs of prostate cancer tissues stained with humanized MN-E6-scFv-Fc anti-MUC1* antibody at 50 ug/mL, then stained with a secondary goat-anti-human HRP antibody.
Figures 30A, 30B:
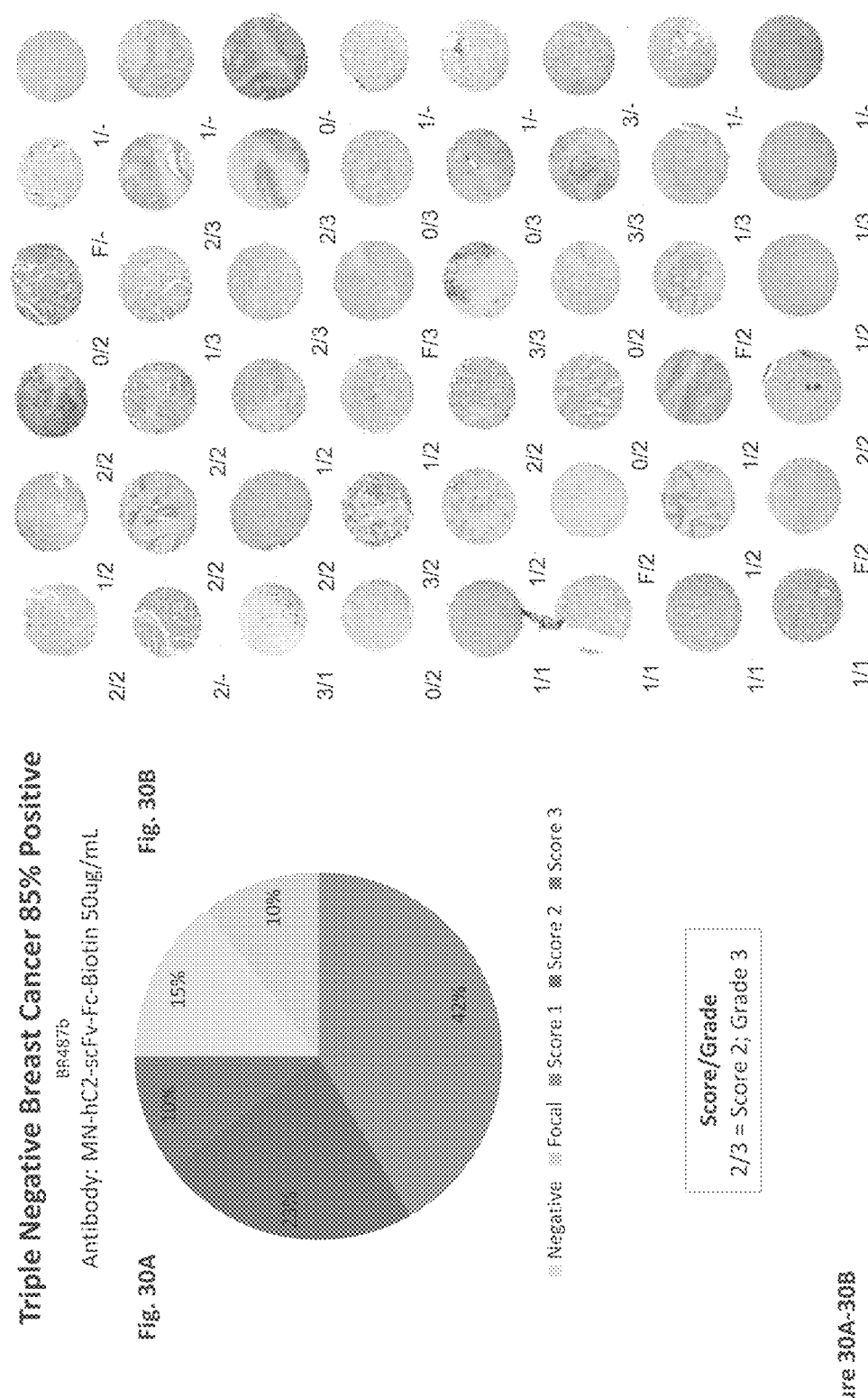
FIGS. 30A-30F show photographs of a triple negative breast cancer array stained with anti-MUC1* antibody huMNC2scFv. The first score shown is the Allred score and the second is the tumor grade. The percentage of the array that scored zero, weak, medium or strong is graphed as a pie chart.
Figures 30C, 30D, 30E, 30F:
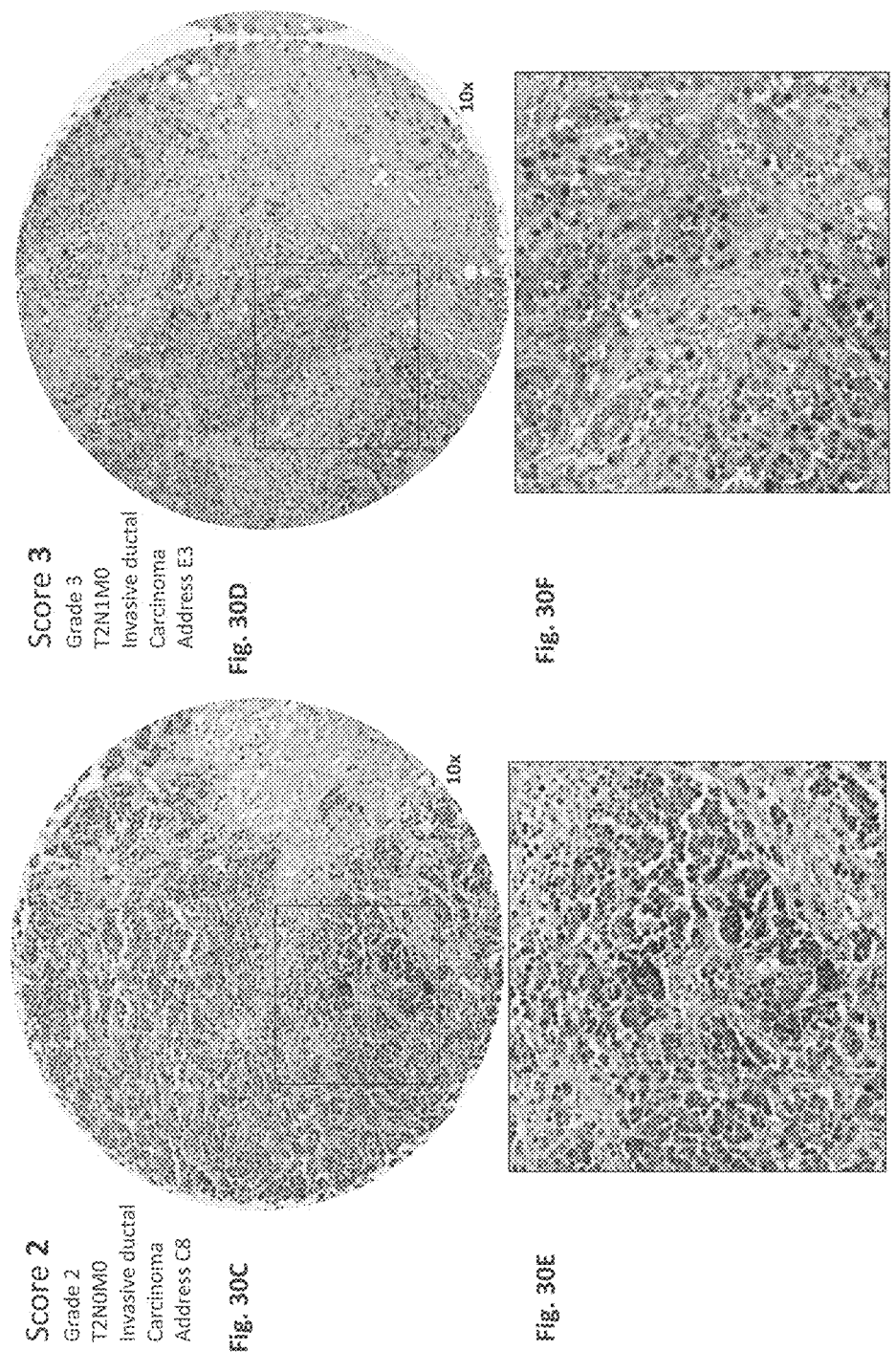
Figures 31C, 31D, 31E, 31F:
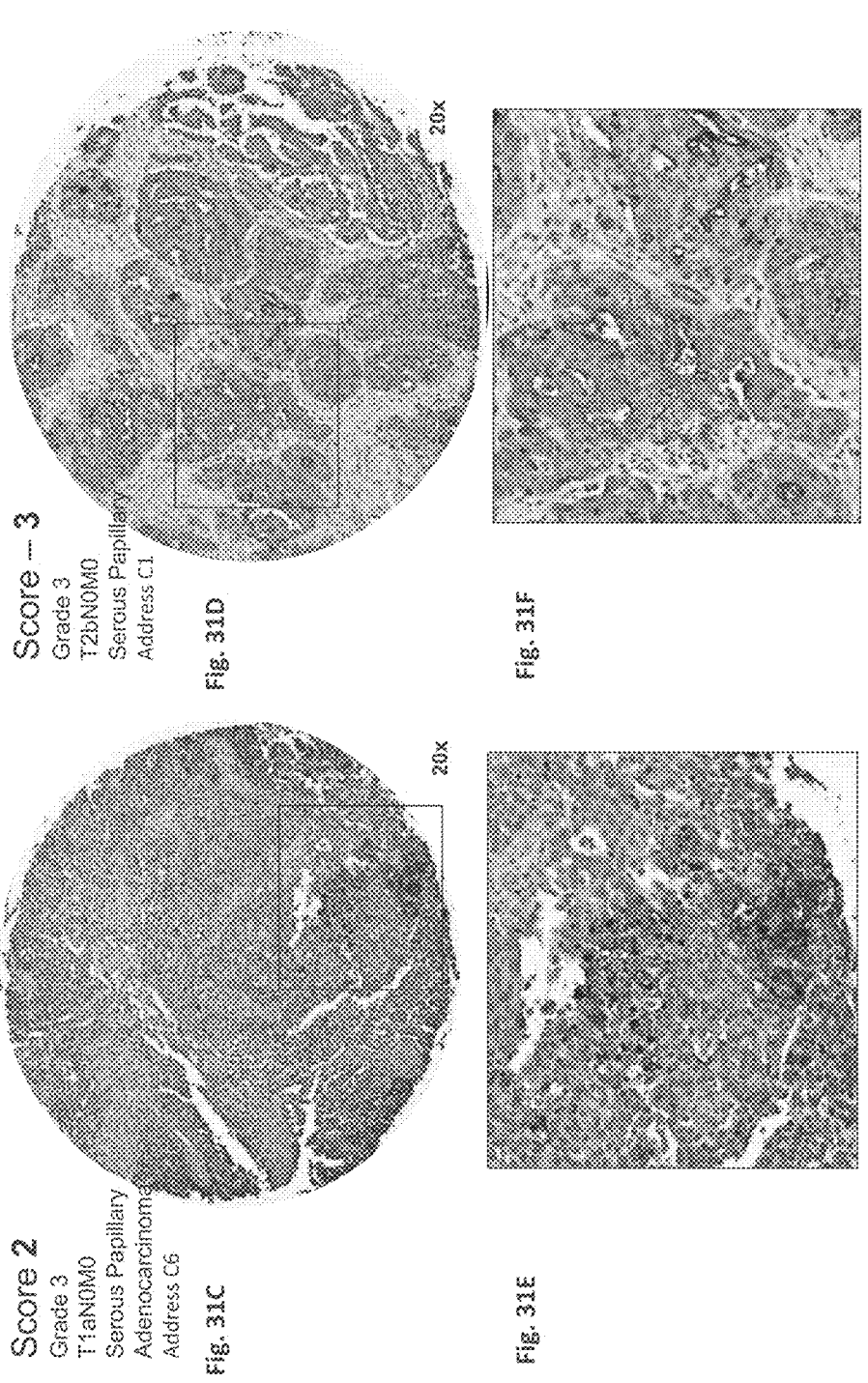
Figures 32A, 32B:
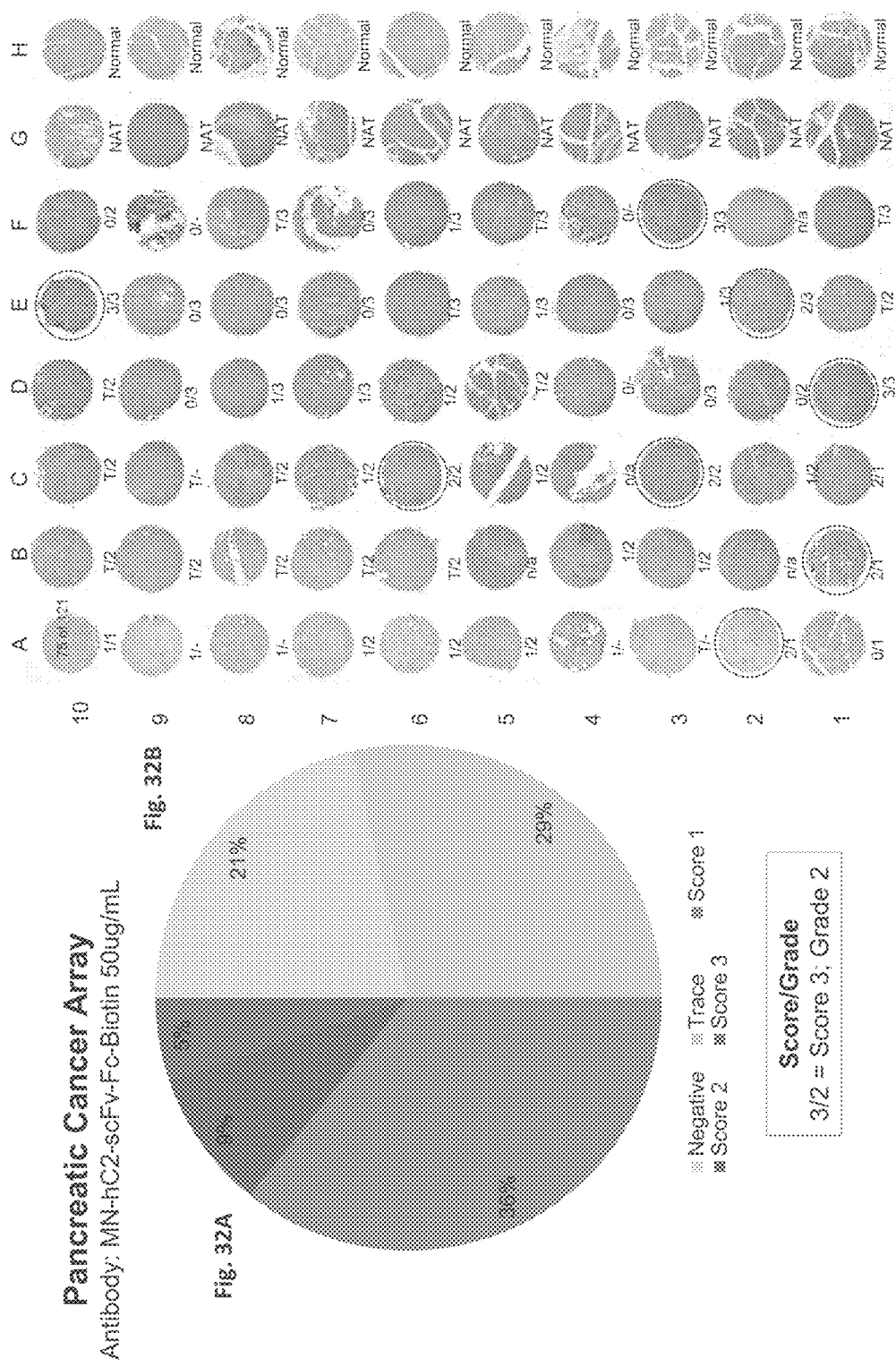
FIGS. 32A-32F show photographs of a pancreatic cancer array stained with anti-MUC1* antibody huMNC2scFv. The first score shown is the Allred score and the second is the tumor grade. The percentage of the array that scored zero, weak, medium or strong is graphed as a pie chart.
Figures 32C, 32D, 32E, 32F:
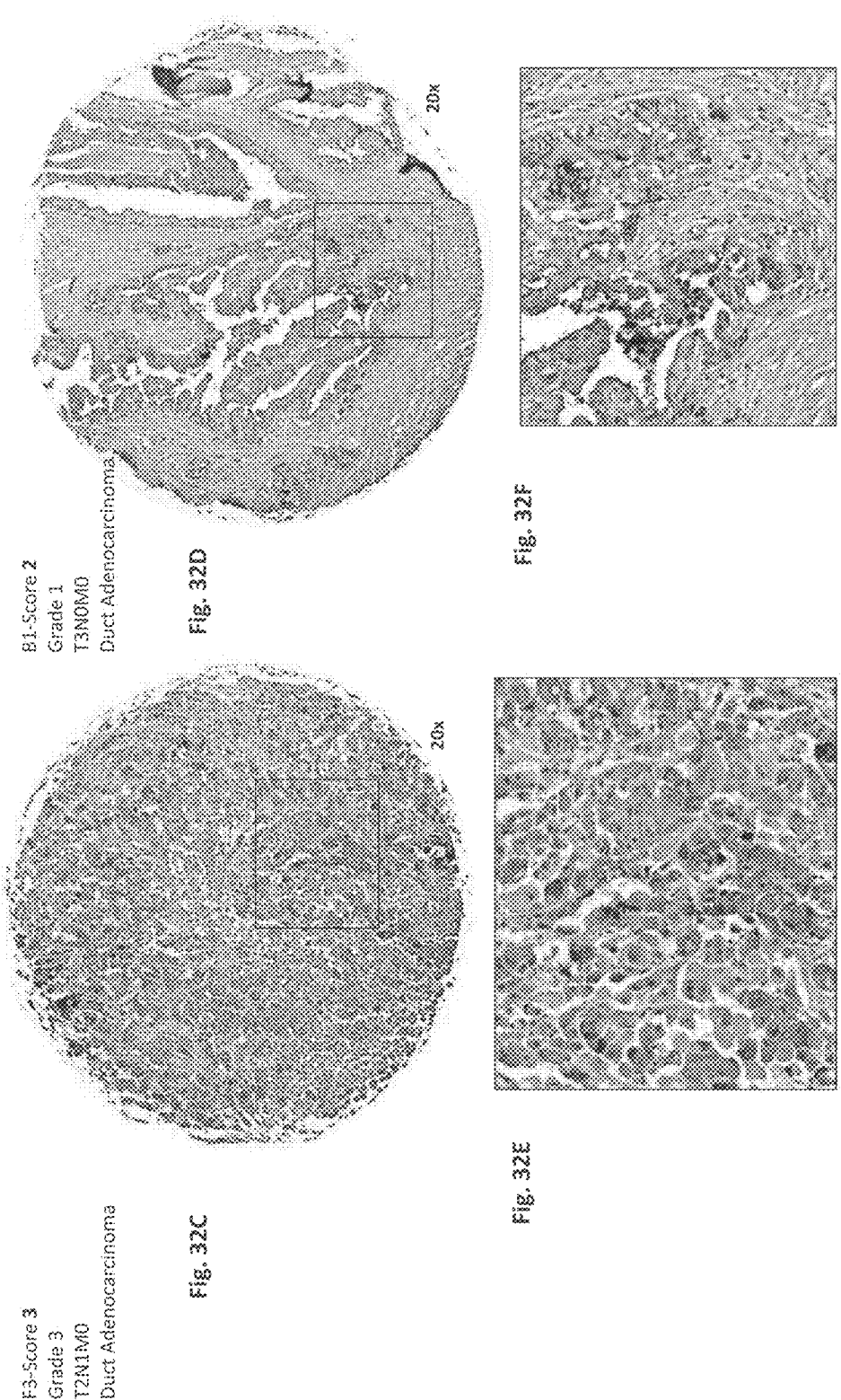
Figures 33A, 33B:
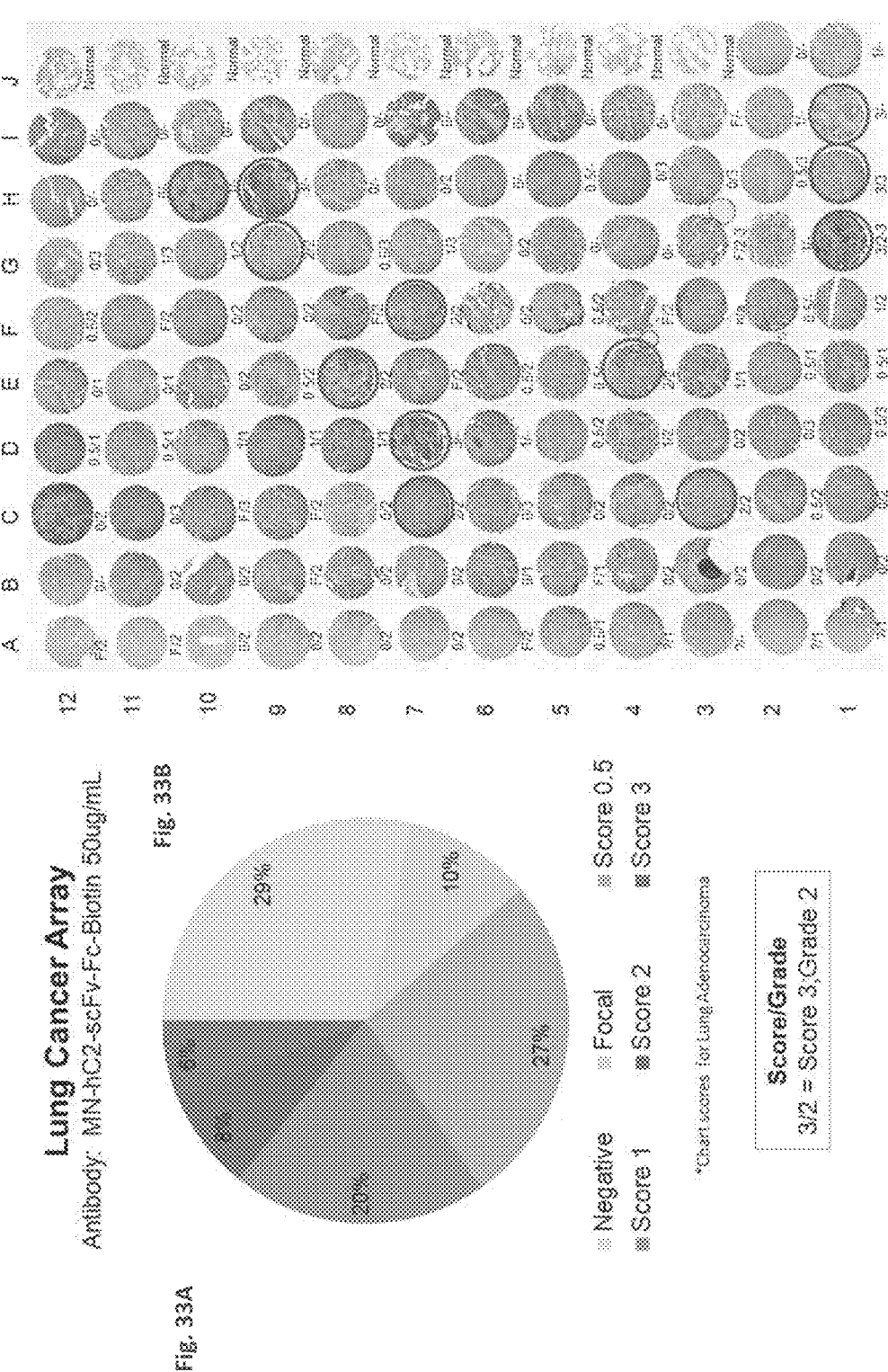
Figures 34A, 34B, 34C, 34D, 34E, 34F, 34G, 34H, 34I:
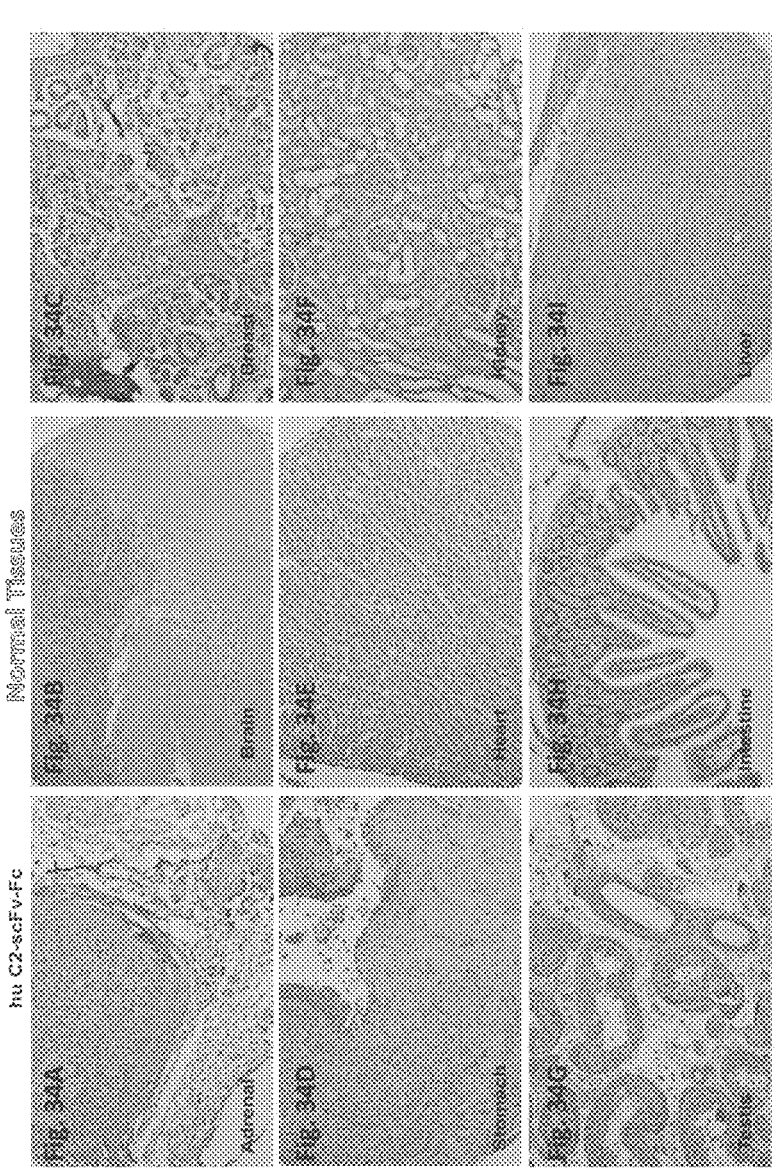
FIGS. 34A-34I show photographs of normal tissues stained with anti-MUC1* antibody huMNC2scFv.

The most accurate way of demonstrating antibody specificity is testing the antibody on normal human tissue specimens compared to cancerous tissue specimens. MN-C2 and MN-E6 were shown to specifically bind to MUC1 or MUC1* positive cancer cells. Several breast tumor arrays were assayed using several anti-MUC1 or MUC1* antibodies. Essentially the studies involving serial sections of breast cancer tissue specimens from over 1,200 different breast cancer patients showed that very little full-length MUC1 remains on breast cancer tissues. The vast majority of the MUC1 expressed is MUC1* and is stained by MN-C2. The analysis was performed by Clarient Diagnostics and tissue staining was scored using the Allred method. For example, FIG. 10 shows serial sections of breast cancer tissue arrays that were stained with either VU4H5, a commercially available anti-MUC1 antibody that binds to the tandem repeats, or MN-C2 that binds to MUC1*. FIGS. 10 and 11 are photographs of breast cancer tissue arrays stained with either VU4H5 which recognizes MUC1-FL (full length) or MN-C2 which recognizes cancerous MUC1*. Tissue staining was scored using Allred scoring method which combines an intensity score and a distribution score. Below the photographs of the tissue arrays are color-coded graphs displaying the results. As can be seen, the arrays stained with VU4H5 are very light and many tissues do not stain at all despite the published reports that MUC1 is aberrantly expressed on over 96% of all breast cancers as evidenced by nucleic acid based diagnostics. In contrast, the arrays stained with MN-C2 are very dark (red versus yellow or white in graph). Additionally, many tissues did not stain at all with anti-full-length MUC1 but stained very dark with MN-C2, (see green boxes in graph). Similarly, we stained normal or cancerous breast tissues with humanized MN-E6 scFv-Fc. The antibody fragment was biotinylated so it could be visualized by a secondary streptavidin based secondary. As can be seen in FIG. 12, hMN-E6 scFv-Fc does not stain normal breast tissue but stains cancerous breast tissue. Further, the intensity and homogeneity of staining increases with tumor grade and/or metastatic grade of the patient (FIG. 12-13). Similarly, hMN-E6 scFv-Fc did not stain normal lung tissue but did stain lung cancer tissue (FIG. 14-18) and the intensity and distribution of staining increased as tumor grade or metastatic grade increased. FIG. 19 shows photographs of normal small intestine and cancerous small intestine tissues stained with humanized MN-E6-scFv-Fc biotinylated anti-MUC1* antibody at 5 ug/mL, then stained with a secondary streptavidin HRP antibody. A) is a normal small intestine tissue. B) is small intestine cancer from patient as denoted in the figure. C,D are photographs of the corresponding serial sections that were stained with the secondary antibody alone. FIG. 20 shows photographs of normal small intestine tissues stained with humanized MN-E6-scFv-Fc anti-MUC1* antibody at 50 ug/mL, then stained with a secondary goat-anti-human HRP antibody. A-D are normal small intestine tissue. E-H are photographs of the corresponding serial sections that were stained with the secondary antibody alone. FIG. 21 shows photographs of cancerous small intestine tissues stained with humanized MN-E6-scFv-Fc anti-MUC1* antibody at 50 ug/mL, then stained with a secondary goat-anti-human HRP antibody. A-D are cancerous small intestine tissue from a patient as denoted in figure. E-H are photographs of the corresponding serial sections that were stained with the secondary antibody alone. FIG. 22 shows photographs of cancerous small intestine tissues stained with humanized MN-E6-scFv-Fc anti-MUC1* antibody at 50 ug/mL, then stained with a secondary goat-anti-human HRP antibody. A-D are cancerous small intestine tissue from a patient as denoted in figure. E-H are photographs of the corresponding serial sections that were stained with the secondary antibody alone. FIG. 23 shows photographs of normal colon tissues stained with humanized MN-E6-scFv-Fc anti-MUC1* antibody at 50 ug/mL, then stained with a secondary goat-anti-human HRP antibody. A-D are normal colon. E-H are photographs of the corresponding serial sections that were stained with the secondary antibody alone. FIG. 24 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a metastatic patient as denoted in figure. E-H are photographs of the corresponding serial sections that were stained with the secondary antibody alone. FIG. 25 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a Grade 2 patient as denoted in figure. E-H are photographs of the corresponding serial sections that were stained with the secondary antibody alone. FIG. 26 shows photographs of colon cancer tissues stained with humanized MN-E6-scFv-Fc anti-MUC1* antibody at 50 ug/mL, then stained with a secondary goat-anti-human HRP antibody. A-D are colon cancer tissue from a metastatic patient as denoted in figure. E-H are photographs of the corresponding serial sections that were stained with the secondary antibody alone. FIG. 27 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone. FIG. 28 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone. FIG. 29 shows photographs of prostate cancer tissues stained with humanized MN-E6-scFv-Fc anti-MUC1* antibody at 50 ug/mL, then stained with a secondary goat-anti-human HRP antibody. A-D are prostate cancer tissue from a patient as denoted in figure. E-H are photographs of the corresponding serial sections that were stained with the secondary antibody alone.

One aspect of the invention is a method for treating a patient diagnosed with, suspected of having, or at risk of developing a MUC1 positive or MUC1* positive cancer, wherein a specimen is obtained from the patient's cancer and is tested for reactivity with an antibody that binds to PSMGFR SEQ ID NO:2, or more specifically to the N-10 peptide. The patient is then treated with an scFv, scFv-Fc or CAR T that comprises antibody variable fragments from the antibody that reacted with their cancer specimen or can be chosen from among MNC2, MNE6, 20A10, 3C2B1, 5C6F3, 25E6, 18G12, 28F9, 1E4, B12, B2, B7, B9, 8C7F3, or H11. Another aspect of the invention is a method for treating a patient diagnosed with, suspected of having, or at risk of developing a MUC1 positive or MUC1* positive cancer, wherein a specimen is obtained from the patient's cancer and is tested for reactivity with MNC2, MNE6, 20A10, 3C2B1, 5C6F3, 25E6, 18G12, 28F9, 1E4, B12, B2, B7, B9, 8C7F3, or H11; the patient is then treated with the antibody, antibody fragment, scFv, scFv-Fc-mut, BiTE or CAR T that comprises portions of the antibody that reacted with their cancer specimen.

As we previously reported, it is MUC1*, the transmembrane cleavage product, not full-length MUC1, the is a growth factor receptor that drives tumor growth. The growth factors that activate MUC1* bind to ectopic sites that are only exposed after cleavage and release of the tandem repeat portion of MUC1. Antibodies of the invention, like the activating growth factors, cannot bind to full-length MUC1. FACS analysis clearly shows that anti-MUC1* antibody MNC2 is unable to bind to HCT-116, MUC1 negative cells (FIG. 35A), binds robustly to those cells if they are transfected with MUC1* (FIG. 35B), but will not bind to HCT cells transfected with full-length MUC1 (FIG. 35C). A commercially available anti-tandem repeat antibody VU4H5 clearly recognizes full-length MUC1 (FIG. 35D).

We discovered that MUC1 can be cleaved to MUC1* by more than one cleavage enzyme and that the site of cleavage affects its fold and consequently affects which monoclonal antibody is able to recognize that form of MUC1*. Different cancer cells or cancerous tissues express different cleavage enzymes. We tested various cleavage enzyme inhibitors on different cancer cell lines and found that an inhibitor that inhibits cleavage of MUC1 in one cancer cell line did not inhibit its cleavage in another cancer cell line. Similarly, PCR experiments showed that cleavage enzymes are expressed at different levels in different cells or cell lines. For example, hematopoietic stem cells of the bone marrow express a MUC1* that is recognized by monoclonal antibody MNC3 but not MNE6 or MNC2 (FIG. 39). The growth of DU145 prostate cancer cells and T47D breast cancer cells is inhibited by the Fabs of MNC2 and MNE6 but not by the Fabs of MNC3 or MNC8, indicating that the cancer cell lines express a MUC1* that is recognized by MNE6 and MNC2 but not by MNC3 or MNC8 (FIG. 42). PCR experiments show that CD34 positive cells of the bone marrow express about 2,500-times more MMP2 and about 350-times more ADAM28 than T47D breast cancer cells, while DU145 prostate cancer cells express about 2,000-times more ADAM TS16, about 400-times more MMP14 and about 100-times more MMP1 than T47D breast cancer cells (FIG. 43 and FIG. 44). Conversely, T47D breast cancer cells express about 80-times more MMP9 than the bone marrow cells and about twice as much as DU145 prostate cancer cells. Various cleavage enzyme inhibitors were tested for their ability to inhibit cleavage in different kinds of cancer cells.

General Strategy for Using Antibodies, Antibody Fragments and CARs that Target the Extracellular Domain of MUC1*

In one aspect of the invention, a second factor, which may be a cleavage enzyme, an antibody, a cytokine, or a second CAR, and a CAR are transduced into the same T cell. In another aspect of the invention, the second factor is on an inducible promoter such that its expression is activated when the CAR engages the targeted cancer cells. In some cases, the expression of the second factor is controlled by an inducible promoter. In one aspect of the invention, expression of the second factor is induced when the immune cell is activated, for example when it recognizes or engages its target. In one example, a T cell is transfected or transduced with a second factor whose expression is induced when the T cell recognizes a target cancer cell. One way to do this is to induce expression of the second factor when, or shortly after, an NFAT protein is expressed or translocated to the nucleus. For example, a sequence derived from an NFAT promoter region is put upstream of the gene for the second factor. In this way, when the transcription factors that bind to the promoter of the NFAT protein are present in sufficient concentration to bind to and induce transcription of the NFAT protein, they will also bind to that same promoter that is engineered in front of the sequence for transcription of the second factor. The NFAT protein may be NFAT1 also known as NFATc2, NFAT2 also known as NFATc or NFATc1, NFAT3 also known as NFATc4, NFAT4 also known as NFATc3, or NFAT5. In one aspect of the invention, the NFAT is NFATc1, NFATc3 or NFATc2. In one aspect of the invention, the NFAT is NFAT2 also known as NFATc1. SEQ ID NO:646 shows nucleic acid sequence of the upstream transcriptional regulatory region for NFAT2. The promoter sequence for NFAT gene may include the nucleic acid sequence of SEQ ID NO:781-783 or SEQ ID NO:815 as examples, but it can be seen that the optimal sequence or minimal sequence for expression of the second factor may be obtained by making fragments, extensions or mutations of the promoter and testing for the strength of the promoter with respect to expression of the second factor. In one aspect of the invention, the transcriptional regulatory region for NFAT2 is engineered upstream of the gene encoding the second factor, which if for cleavage enzyme MMP9 (SEQ ID NO:647) or the catalytic sub-unit of MMP9 (SEQ ID NO: 648). In one aspect of the invention, the NFAT is NFATc3 and the promoter sequence of NFATc3 includes nucleic acid sequences from SEQ ID NO:816. In one aspect of the invention, the transcriptional regulatory region for NFATc3 is engineered upstream of the gene encoding the second factor, here as an example is MMP9. In another aspect of the invention, the NFAT is NFATc2. SEQ ID NO:817-818 shows nucleic acid sequence of the upstream transcriptional regulatory region for NFATc2. In one aspect of the invention, the transcriptional regulatory region for NFATc2 is engineered upstream of the gene encoding the second factor, which may be cleavage enzyme MMP9 (SEQ ID NO:647) or the catalytic sub-unit of MMP9 (SEQ ID NO: 648).

Another method for having the expression of the second factor induced when the T cell or CAR T cell is activated is to have the gene for the second factor on an inducible promoter where the NFAT protein itself binds to and induces transcription of the second factor. In this case, an NFAT response element (NFAT RE) may be positioned upstream of the gene for the second factor or fragment of the second factor. The NFAT may bind to its responsive element upstream of the second factor alone or as part of a complex. The NFAT protein may be NFATc1, NFATc2, NFATc3, NFATc4, or NFAT5. In a preferred embodiment, the NFAT protein is NFAT2 aka NFATc1, aka NFATc. The gene of the second factor or fragment thereof is cloned downstream of an NFAT-response element (SEQ ID NO:649), which may be repeats of the response element (SEQ ID NO:650) and CMV minimal promoter (mCMV) (SEQ ID NO:651) to induce expression of second factor by NFAT protein. The NFAT response element may include nucleic acid sequence of NFAT consensus sequence (SEQ ID NO:804). The NFAT response element may include the nucleic acid sequence of SEQ ID NOS: 805-814 as examples, but it can be seen that the optimal sequence or minimal sequence for expression of the second factor may be obtained by making fragments, extensions or mutations of the responsive element nucleic acid and testing for the strength of the responsive element with respect to expression of the second factor. The enhancer region of Foxp3 also contains NFAT response elements within the 120-bp from 2079 to 2098 (SEQ ID NO:821). The NFAT response element may include nucleic acid NFAT consensus sequence of (5'-catttttccat-3') (SEQ ID NO:819) or (5'-tttttcca-3') (SEQ ID NO: 820), which NFATc1 specifically binds to (Xu et al., Closely related T-memory stem cells correlate with in vivo expansion of CAR. CD19-T cells and are preserved by IL-7 and IL-15, *Blood* 2014 123:3750-3759), or repeats thereof. The NFAT response elements may also be separated by nucleic acid spacer sequences. Other NFAT responsive elements may exist and may further be discovered, and a skilled artisan in the art when directed to determine NFAT responsive element may do so by carrying out molecular biological assays to obtain it given the guidance of at least the responsive elements as set forth as SEQ ID NOS: 804-814 albeit as only mere examples. In one aspect of the invention, the cleavage enzyme that is downstream of the NFAT-response element and CMV minimal promoter is MMP9 (SEQ ID NO:652). In another aspect of the invention, the cleavage enzyme is a catalytic sub-unit of MMP9 (SEQ ID NO:653).

Because NFATs 1~4 are regulated by the calcineurin pathway, potential toxicities that may arise in a patient can be stopped by treatment with an immunosuppressive agent such as FK506, Cyclosporin, Cyclosporin A, or Tacrolimus that block calcineurin activity and inhibit NFAT translocation to the nucleus. The T cell transduced or transfected with a cleavage enzyme on an inducible promoter may also be transfected or transduced with a CAR that recognizes a protein or molecule on the cancer cell. In a specific example, the cleavage enzyme is one that is able to cleave MUC1 full-length and the CAR bears an antibody fragment that directs it to MUC1* on the surface of cancer cells.

To determine which cleavage enzymes cleave MUC1 on cancer cells, we tested a series of MMP and ADAM enzyme inhibitors. These experiments pointed to MMP9 as being an important cleavage enzyme in cancer cells. To confirm that MMP9 cleaves MUC1 on cancer cells, we transfected HCT-116 MUC1 negative colon cancer cells with a mimic of full-length MUC1 having 41 tandem repeat domains: HCT-MUC1-41TR. Through single cell cloning we were able to establish this cell line wherein MUC1 only minimally gets cleaved to MUC1*. FIGS. 36A-36D show Western blots and FACS analysis showing that HCT-MUC1-41TR is 95% positive for full-length MUC1 and only 5-10% positive for the cleaved form, MUC1*. HCT-MUC1-41TR cells were incubated with MMP9 at varying concentrations and then assayed by immunofluorescence to measure binding of MNC2 monoclonal antibody to the resultant cells. As can be seen in FIGS. 37A-37C binding of MNC2 increased as the concentration of MMP9 added to the cells increased. These experiments show that MMP9 cleaves MUC1 to a form that is recognized by MNC2. The human cancer tissue array studies we performed (FIG. 30A-30F, FIG. 31A-31F, FIG. 32A-32F, FIG. 33A-33F) show that MNC2 recognizes the form of cleaved MUC1 that is present on cancerous tissue but not on healthy cells or tissues (FIG. 34A-34I). Importantly, MNC2 does not recognize the form of cleaved MUC1 that is expressed on healthy hematopoietic stem cells of the bone marrow (FIGS. 39-41).

In one aspect of the invention, an immune cell is transduced with both a CAR to target the immune cell to the tumor, and a cleavage enzyme. The CAR and the cleavage enzyme can be encoded on the same plasmid or on two different plasmids. In one aspect, the cleavage enzyme is on an inducible promoter. In another aspect, expression of cleavage enzyme is induced by a protein that is expressed when the immune cell is activated. In one case, expression of the cleavage enzyme is induced by an NFAT protein. In another aspect, expression of the cleavage enzyme is induced by NFATc1. In another aspect, expression of the cleavage enzyme is induced when one of the NFAT proteins binds to an NFAT response element that is inserted upstream of the gene for the cleavage enzyme or a catalytically active fragment thereof. In one aspect, the cleavage enzyme is MMP9 or a fragment of MMP9 that is catalytically active.

In one aspect of the invention, the cleavage enzyme is MMP9 (SEQ ID NO:643). Some cleavage enzymes are naturally expressed as pro-enzymes that need to be activated. This can be accomplished by biochemical means, by expressing a co-enzyme that activates a cleavage enzyme or by engineering the enzyme in an activated form. The invention anticipates overcoming this problem by co-expressing the cleavage enzyme with its activator. In one aspect of the invention, the cleavage enzyme is MMP9 and the co-activator is MMP3. In another aspect of the invention, the cleavage enzyme is expressed in a form that is already active, for example by expressing a fragment of the cleavage enzyme that still has catalytic function. In one case, the cleavage enzyme is an MMP9 fragment that is catalytically active. One example of an MMP9 catalytic fragment is given as SEQ ID NO:645.

MMP9, which must be activated by MMP3, is overexpressed in a large percentage of solid tumors. Further, it is known that MNC2 anti-MUC1* monoclonal antibody recognizes MUC1 after it is cleaved by MMP9. The various breast, ovarian, pancreatic and lung cancer tissue arrays that were shown in FIGS. 30-33 were probed with MNC2-scFv, further indicating that MUC1 in these cancers is being cleaved by MMP9. To see if cleavage of tumors by MMP9 would increase T cell access to the tumor, we did a series of experiments using a cell line that expresses full-length MUC1, HCT-MUC1-41TR, a breast cancer cell line that is a high expresser of both full-length MUC1 and MUC1* and a MUC1 negative cell line that we transfect with MUC1*45. We transfected cells with MMP9 and MMP3, which activates MMP9. We took the supernatant of those cells, which contained activated MMP9, and added it to the various cells, which were then co-cultured with T cells transduced with an anti-MUC1* CAR: huMNC2-CAR44. The result was greatly increased CAR T cell killing of the targeted MUC1/MUC1* positive cancer cells, compared to the control cells that were not incubated with a MUC1 cleavage enzyme.

APMA is a biochemical that activates MMPs. We used APMA along with the conditioned media of cells that we transfected with either MMP9 or ADAM17 to see if any of these cleavage enzymes would cleave MUC1 on the HCT-MUC1-41TR cell line that only expresses full-length MUC1. As controls, we also tested the enzymes on HCT-MUC1* cells. The MUC1 and MUC1* expressing cells were stained with a red dye, CMTMR. Human T cells that were transduced with an anti-MUC1* CARs, CAR44 or CAR50 were co-cultured with the cancer cells. Untransduced T cells were used as a control (FIG. 45A-45P). As can be seen in FIG. 45B, FIG. 45C, and FIG. 45D, the anti-MUC1* CAR T cells effectively recognized and clustered the HCT-MUC1* cancer cells, which is a sign of T cell activation and killing. However, no CAR T cell induced clustering is visible in the wells containing HCT-MUC1-41TR, the full-length MUC1 expressing cells (FIG. 45F, FIG. 45G, and FIG. 45H). However, the cells that were incubated with activated MMP9 show dramatic increase in CAR T cell induced clustering (FIG. 45J, FIG. 45K, and FIG. 45L), indicating that MMP9 cleaved the full-length MUC1 to a form of MUC1* that is recognized by MNC2 monoclonal antibody and more specifically by huMNC2-scFv. ADAM17 had no apparent effect. ADAM17 either did not cleave MUC1 or cleaved it at a position that is not recognized by MNC2, which is more likely (FIG. 45N-45P).

We performed the same experiment, this time using T47D breast cancer cells that were hard to kill using anti-MUC1* CAR T cells presumably because they express high levels of full-length MUC1 as well as MUC1* (FIG. 46A-46T). As can be seen in FIGS. 46B, 46C, and 46D, anti-MUC1* CAR44 and CAR50 have little effect on the T47D cancer cells. Only in FIG. 46D, which is CAR44 at the highest level of CAR expression in the T cells, do we see a small amount of CAR T cell induced clustering. However, the presence of activated MMP2 (FIG. 46J, 46K, 46L) or activated MMP9 (FIG. 46R, 46S, 46T) shows a dramatic increase in CAR T cell recognition, clustering and killing, showing that cleavage of full-length MUC1 increases T cell access to the cancer cells. To ensure that the addition of the APMA was not inducing cleavage or anti-MUC1* CAR T recognition by some other mechanism, we made a catalytically active form of MMP9 and added it to T47D cells that were then co-cultured with MNC2-CAR44 T cells (FIG. 47A-47I). As can be seen in the figure, MNC2-CAR T cells recognize and cluster cells transfected with MUC1* (FIG. 47B-47C), poorly cluster T47D breast cancer cells that express both full-length MUC1 and MUC1* (FIG. 47E-47F), but robustly bind to and cluster the T47D cells after the addition of the catalytically active MMP9 (FIG. 47H-47I). This results supports the claim that MNC2 does not recognize full-length MUC1 but does recognize the growth factor receptor MUC1*. Note that the full-length MUC1 expressed on this cell line may sterically hinder the binding of CAR T cells near the cell membrane.

In another example, T47D MUC1 positive tumor cells were incubated with a recombinant catalytic domain of MMP9 (Enzo Life Sciences, Inc., Farmingdale, NY) at either 100 ng/mL or 500 ng/mL. Western blot analysis showed that the MUC1/MUC1* positive cancer cells underwent extensive cleavage of MUC1 to MUC1*. In another example, T47D breast cancer cells were pre-incubated with a human recombinant MMP9 catalytic domain protein then co-cultured with anti-MUC1* CAR44 T cells. The specific killing of the T47D cells by CAR44 T cells was monitored in real-time on an xCelligence instrument that measures impedance as a function of time. This analysis uses electrode arrays upon which cancer cells are plated. The adherent cancer cells insulate the electrode and cause an increase in impedance as they grow. Conversely, T cells are not adherent and remain in suspension so do not increase or decrease impedance. However, if the T cells or CAR T cells kill the cancer cells on the electrode plate, the cancer cells ball up and float as they die, which causes the impedance to decrease. The addition of MMP9 catalytic domain dramatically increased the killing of T47D cancer cells. FIG. 48 shows an xCelligence graph of T47D breast cancer cells in co-culture with either untransduced T cells, as a control, or huMNC2-CAR44 T cells over a 45 hour period. After 18 hours of cancer cell growth, a catalytic sub-unit MMP9 was added to some of the cells. At 25 hours, T cells were added. As can be seen, huMNC2-CAR44 T cell killing is greatly improved when the T47D cells are pre-incubated with cleavage enzyme MMP9. In the xCelligence system, target cancer cells, which are adherent, are plated onto electrode array plates. Adherent cells insulate the electrode and increase the impedance. The number of adherent cancer cells is directly proportional to impedance. T cells are not adherent and do not contribute to impedance. Therefore, increasing impedance reflects growth of cancer cells and decreasing impedance reflects killing of cancer cells. Prostate cancer cell line DU145 expresses both MUC1 and MUC1* but at a much lower level of expression than T47D cells. DU145 cells are efficiently killed by anti-MUC1* CAR T cells in the presence or absence of a cleavage enzyme.

FIG. 49 shows an xCelligence graph of DU145 prostate cancer cells in co-culture with either untransduced T cells, as a control, or huMNC2-CAR44 T cells over a 45 hour period. After 18 hours of cancer cell growth, a catalytic sub-unit MMP9 was added to some of the cells. At 25 hours, T cells were added. As can be seen, huMNC2-CAR44 T cell killing of low density MUC1/MUC1* positive cancer cells is not affected by pre-incubation with cleavage enzyme MMP9. DU145 cancer cells express a significantly lower amount of MUC1 which includes the full-length form as well as MUC1*. The lower density of full-length MUC1 does not sterically hinder T cell access to the membrane proximal MUC1*. DU145 cells represent an early stage cancer that expresses both full length and cleaved MUC1 but at lower levels so that T cell access is not sterically hindered. T47D cells represent mid-stage cancers that express high levels of both MUC1 and MUC1*, wherein the density of MUC1 full-length sterically hinders access of T cells to the tumor. HCT-MUC1* cells are a MUC1 negative cell line that has been stably transfected with MUC1*45, and they represent late stage cancer cells. It is significant that MUC1 cleaved to MUC1* by MMP9 is recognized by the anti-MUC1* antibody MNC2, which is the targeting head of the CAR. Immune cell access to tumor antigens on the cancer cell surface can be sterically hindered by the presence of bulky extra cellular domain proteins or other obstructing elements also known as the tumor micro-environment. The aforementioned serve as an example that can be extended to improve the efficacy of CAR T therapies that target other tumor antigens. In one aspect of the invention, an immune cell is transfected or transduced with both a CAR comprising an antibody fragment that targets a tumor antigen and a cleavage enzyme. In another aspect of the invention, an immune cell is transfected or transduced with both a CAR comprising an antibody fragment that targets a tumor antigen and a cleavage enzyme that cleaves a tumor antigen to a form recognized by the antibody fragment of the CAR. In one aspect, an immune cell is transfected or transduced with both a CAR comprising an antibody fragment that targets a tumor antigen and a cleavage enzyme that cleaves a tumor antigen to a form recognized by the antibody fragment of the CAR, wherein the antibody fragment of the CAR recognizes MUC1* extra cellular domain and the cleavage enzyme cleaves MUC1 to MUC1*. In one aspect, an immune cell, which may be a T cell or an NK cell, is transfected or transduced with a CAR comprising an antibody fragment derived from MNC2, MNE6, MNC3 or MNC8 and a cleavage enzyme chosen from the group comprising MMP1, MMP2, MMP3, MMP7, MMP8, MMP9, MMP11, MMP12, MMP13, MMP14, MMP16, ADAM9, ADAM10, ADAM17, ADAM 19, ADAMTS16, ADAM28 or a catalytically active fragment thereof.

In one aspect of the invention, a person diagnosed with cancer or at risk of developing cancer is administered a sufficient amount of an immune cell transduced with both a CAR and a cleavage enzyme. In another aspect of the invention, a person diagnosed with cancer or at risk of developing cancer is administered a sufficient amount of an immune cell transduced with both a CAR and a cleavage enzyme, wherein the cleavage enzyme is on an inducible promoter that is activated by proteins that are expressed when the immune cell becomes activated. In another aspect of the invention, a person diagnosed with cancer or at risk of developing cancer is administered a sufficient amount of an immune cell transduced with both a CAR and a cleavage enzyme, wherein the cleavage enzyme is on an inducible promoter that is activated by one or more NFAT. In one case the NFAT is NFATc1. In another aspect, the NFAT is NFATc3. In another aspect, the NFAT is NFATc2. In any of the instances above, the extra cellular domain of the CAR comprises a fragment of an anti-MUC1* antibody. In one aspect, the anti-MUC1* antibody is MNC2scFv or a humanized form of MNC2scFv. In another aspect, the anti-MUC1* antibody is MNE6scFv or a humanized form of MNE6scFv. In any of the instances above, the immune cell can be a T cell, an NK cell, a mast cell, or a dendritic cell.

It is not intended that the present invention be limited to one or two specific methods of having expression of a cleavage enzyme induced by an activated T cell. We have demonstrated specific expression of a cleavage enzyme only upon T cell activation by constructing a plasmid with the cleavage enzyme gene downstream of an NFAT promoter sequence or downstream of one or more repeats of NFAT response elements. In another aspect of the invention, expression of the cleavage enzyme is induced by constructing a plasmid where the cleavage enzyme gene is inserted downstream of an IL-2 promoter sequence or downstream of an IL-2 response element, then inserting the plasmid into an immune cell. In another aspect of the invention, expression of the cleavage enzyme is induced by constructing a plasmid where the cleavage enzyme gene is inserted downstream of a Calcineurin promoter sequence or downstream of a Calcineurin response element, then inserting the plasmid into an immune cell and then administering to a patient for the treatment or prevention of cancers. There are also drug-inducible plasmids that can be used to induce expression of the cleavage enzyme or used to stop expression induced by an element of an activated T cell. These drug inducible systems may include tetracycline-inducible systems, Tet-on, Tet-off, tetracycline response elements, doxycycline, tamox-ifen inducible systems, ecdysone inducible systems and the like.

It is not intended that the present invention be limited to one or two specific promoters used in the plasmids encoding the CARs or inducible cleavage enzymes. As is known by those skilled in the art, many promoters can be interchanged including SV40, PGK1, Ubc, CAG, TRE, UAS, Ac5, poly-hedron, CaMKIIa, GAL1, GAL10, TEF1, GDS, ADH1, CaMV35S, Ubi, H1 and U6. Another solution to the problem of steric hindrance of CAR T cell access, caused by bulky cell surface proteins such as MUC1-FL, is to increase the length of the linker region of the CAR that is expressed by the T cell. In standard design CARs, the length of the extracellular linker region between the transmembrane por-tion and the antibody fragment is about 45-50 amino acids in length. We made long-arm CARs where the length of the extracellular linker is extended from about 50 amino acids to 217-290 amino acids. Co-culture assays show that CARs with longer extracellular linkers have improved access to the tumor-associated antigen on the target cancer cells.

BiTEs

Divalent (or bivalent) single-chain variable fragments (di-scFvs, bi-scFvs) can be engineered by linking two scFvs. This can be done by producing a single peptide chain with two $V_H$ and two $V_L$ regions, yielding tandem scFvs. Another possibility is the creation of scFvs with linker peptides that are too short for the two variable regions to fold together (about five amino acids), forcing scFvs to dimerize. This type is known as diabodies. Diabodies have been shown to have dissociation constants up to 40-fold lower than corre-sponding scFvs, meaning that they have a much higher affinity to their target. Consequently, diabody drugs could be dosed much lower than other therapeutic antibodies and are capable of highly specific targeting of tumors in vivo. Still shorter linkers (one or two amino acids) lead to the forma-tion of trimers, so-called triabodies or tribodies. Tetrabodies have also been produced. They exhibit an even higher affinity to their targets than diabodies.

All of these formats can be composed from variable fragments with specificity for two different antigens, in which case they are types of bispecific antibodies. The furthest developed of these are bispecific tandem di-scFvs, known as bi-specific T-cell engagers (BiTE antibody con-structs). BiTEs are fusion proteins consisting of two scFvs of different antibodies, on a single peptide chain of about 55 kilodaltons. One of the scFvs may bind to T cells such as via the CD3 receptor, and the other to a tumor cell via a tumor specific molecule, such aberrantly expressed MUC1*.

Another aspect of the invention is a method for treating a patient diagnosed with, suspected of having, or at risk of developing a MUC1 positive or MUC1* positive cancer, wherein the patient is administered an effective amount of a BiTE wherein one antibody variable fragment of the BiTE binds to a T cell surface antigen and the other antibody variable fragment of the BiTE binds to PSMGFR (SEQ ID NO:2), or more specifically to N-10 peptide. In one case, the antibody variable fragment of the BiTE that binds to MUC1* comprises portions of MNC2, MNE6, 20A10, 3C2B1, 5C6F3, 25E6, 18G12, 28F9, 1E4, B12, B2, B7, B9, 8C7F3, or H11.

In another aspect of the invention, MUC1* peptides including PSMGFR (SEQ ID NO: 2), or most or all of N-10 peptide are used in adoptive T cell approaches. In this case, a patient's T cells are exposed to the MUC1* peptides and through various rounds of maturation, the T cells develop MUC1* specific receptors. The adapted T cells are then expanded and administered to the donor patient who is diagnosed with, suspected of having, or is at risk of devel-oping a MUC1* positive cancer.

A series of CARs were also made that had MNC2 and humanized MNC2 as the extra cellular, targeting head of the CAR. The constructs for these CARs were inserted into a plasmid that was then inserted into a Lenti viral vector. Human T cells were then transduced with the lenti viral vector carrying the MNC2 CARs and huMNC2 CARs. MNC2-scFv-CARs that were mouse sequence or humanized were generated. In one aspect of the invention, the CAR comprised huMNC2-scFv-short hinge region-transmem-brane domain derived from CD8-short intracellular piece-4-1BB-3zeta. In another aspect, the transmembrane domain was derived from CD4 transmembrane sequence. In another aspect, the intracellular co-stimulatory domain was CD28-3zeta. In yet another aspect, the intracellular co-stimulatory domain was CD28-4-1BB-3zeta.

There are a variety of methods for assessing whether or not T cells recognize a target cell and are in the process of mounting an immune response. T cells cluster when they recognize a target or foreign cell. This can be readily seen with the naked eye or at low magnification. The appearance of CAR T cell clustering when co-cultured with target cancer cells is one measure of: a) whether or not they recognize the cells as target cells; and b) whether or not they are getting activated to attack the targeted cells, which in this case are cancer cells. FIGS. 45-47 show photographs of MUC1* positive T47D breast cancer cells that were either stably transfected with mCherry or dyed with CMTMR, so are red, which were co-cultured with either human T cells without a CAR or human T cells transduced with huMNC2-scFv-CAR44, or with huMNC2-scFv-CAR50. The CAR T cells are clear. As can be seen, there is no T cell induced clustering of the cancer cells when the T cell does not carry a CAR. However, when T cells carrying a MUC1* targeting CAR, there is dramatic clustering of the MUC1* positive cancer cells.

After T cells recognize and cluster target cells, they overexpress perforin and granzyme B. Together these two molecules activate a cell death pathway in the targeted cell. It is thought that the perforin makes a hole in the target cell into which the T cell injects granzyme B which then activates apoptotic proteases, causing the target cell to lyse. FIG. 55 and FIG. 56 show huMNC2-scFV-CAR44 T cells binding to target MUC1* positive prostate cancer and pan-creatic cancer cells and injecting granzyme B.

Another measure of whether or not a T cell has recognized a target cell and is activated to kill that cell, is the upregu-lation and secretion of cytokines, interferon gamma (IFN-g) and interleukin-2 (IL-2), by the T cell. Activation of CAR T cells, as evidenced by IFN-g and IL-2 secretion, can be readily measured in vitro. CAR T cells are co-cultured with target cells and after an incubation period, the conditioned media is assayed by ELISA to detect secreted IFN-g and IL-2. In order to determine the cancer-specificity of CAR T cells wherein the targeting head of the CAR was either huMNC2 or huMNE6, these experiments were performed with huMNC2-CAR44 T cells and huMNE6-CAR44 T cells in co-culture with MUC1* positive cancer cells and normal cells. Table 1 details the MUC1 positive normal or primary cells that were tested.

TABLE 1

| Cell Line | ATCC Designation | Tissue | Origin |
|---|---|---|---|
| Hep.G2 | | Liver | |
| THLE-3 | CRL-11233 | Liver | The THLE-2 (ATCC CRL-10149 and the THLE-3 (ATCC CRL-11233) cell lines were derived from primary normal liver cells by infection with SV40 large T antigen. THLE-2 and THLE-3 cells express phenotypic characteristics of normal adult liver epithelial cells. They are nontumorigenic when injected into athymic nude mice, have near-diploid karyotypes, and do not express alpha-fetoprotein. |
| Lonza Primary Hepatocytes | HUM181141 | Liver | Male, Caucasian 2.0 months old Induction Fold CYP1A2 (a) 14.0 Induction Fold CYP2B6 (b) 13.0 Induction Fold CYP3A4 (c) 44.0 Basal Activity CYP1A2 2.6 Basal Activity CYP2B6 0.7 Basal Activity CYP3A4 14.0 Additional Information: Inducer/Marker Metabolite (a) 0.05 mM Omeprazole/Acetaminophen (b) 1 mM Phenobarbital/ Hydroxybupropion (c) 0.01 mM Rifampicin/6-Beta-Hydroxytestosterone Basal activity is expressed as: pmol/million cells/minute |
| T/G HA-VSMC | CRL-1999 | Aortic Smooth Muscle | 11 months Female, Caucasian |
| CCD-18Lu | CCL-205 | Lung | This fibroblast-like cell line was derived from the lung tissue of a 2 month, 17-day-old Black female. The donor had cerebral anoxia, cardiac anomaly, sepsis, endocardial cushion defect and fetal alcoholic syndrome. Female, Black 2.5 months |
| HBEC-5i | CRL-3245 | Brain endothelium | Derived from small fragments of human cerebral cortex obtained from patients who had died of various causes. |
| Hs 738.St/Int | CRL-7869 | Stomach/Intestine | 18 weeks gestation fetus Male, Caucasian Part of the NBL Cell Line Collection. This cell line is neither produced nor fully characterized by ATCC. We do not guarantee that it will maintain a specific morphology, purity, or any other property upon passage. |
| MCF-12A | CRL-10782 | Breast | The MCF-12A cell line is a non-tumorigenic epithelial cell line established from tissue taken at reduction mammoplasty from a nulliparous patient with fibrocystic breast disease that contained focal areas of intraductal hyperplasia. The line was produced by long term culture in serum free medium with low Ca++ concentration. MCF-12A was derived from adherent cells in the population. |
| Hs 1.Tes | CRL-7002 | Testis | Male, Caucasian second trimester Part of the NBL Cell Line Collection. This cell line is neither produced nor fully characterized by ATCC. We do not guarantee that it will maintain a specific morphology, purity, or any other property upon passage. |
| HRCE | Lonza: catalogue #CC-2554 Lot #0000542104 | Kidney | Human Renal Cortical Cells (HRCE) are from proximal and distal tubules. Donor info: 49 year old female, passage 2, 95% viability, doubling time (hours) 24 hrs |

FIG. 50 is a graph of PCR measurement of the various cell lines tested, wherein mRNA levels of MUC1 are measured. The cancer cell lines that were tested in these assays were HCT-MUC1* and T47D breast cancer cells. These cells were co-cultured with huMNC2-CAR44 human T cells. Co-culture of huMNC2-CAR44 T cells with the cancer cells induced the CAR T cells to secrete large amounts of IFN-g and IL-2 into the surrounding media, yet co-culture with the MUC1 positive normal cells induced no secretion of the cytokines (FIG. 51 and FIG. 52). In addition to testing for IFN-g and IL-2 secretion by the CAR T cells, the normal cells were assayed for signs of cell death, which could have been induced by the CAR T cells if the antibody targeting head were not extremely cancer-specific. After co-culture with huMNC2-CAR44 T cells, the cells were incubated with a cell death marker, then assayed by FACS. huMNC2-CAR44 T cells induced no cell death in the normal cells (FIG. 53A-53J).

In addition to FACS analysis, many researchers now use an xCELLigence instrument to measure CAR T killing of cancer cells. FACS is not the best method for tracking T cell induced cell killing because the T cells lyse the target cell. By FACS it is difficult to measure dead cells because they are excluded as cell debris, so one must infer an amount of cell killing and by various methods determine if the missing cells are T cells or cancer cells.

The xCELLigence instrument uses electrode arrays upon which cancer cells are plated. The adherent cancer cells insulate the electrode and so cause an increase in impedance as they grow. Conversely, T cells are not adherent and remain in suspension so do not contribute to insulation of the electrode which would increase impedance. However, if the T cells or CAR T cells kill the cancer cells on the electrode plate, the cancer cells ball up and float off as they die, which causes the impedance to decrease. The xCELLigence instrument measures impedance as a function of time, which is correlated to cancer cell killing. In addition, the electrode plates also have a viewing window. When CAR T cells effectively kill the adsorbed target cancer cells, there is a decrease in impedance but also one can see that there are no cancer cells left on the plate surface.

FIGS. 55A-55H show the cytotoxic effect of huMNC2-CAR44 T cells on MUC1* positive DU145 prostate cancer cells as measured by a variety of assays. FIG. 55A is a fluorescent photograph of untransduced T cells co-cultured with the prostate cancer cells, wherein granzyme B is stained with a red fluorophore. FIG. 55C is a fluorescent photograph of huMNC2-CAR44 T cells co-cultured with the prostate cancer cells, wherein granzyme B is stained with a red fluorophore. FIG. 55D is the DAPI and granzyme B merge. FIG. 55E is a FACS scan for fluorescently labeled granzyme B for untransduced T cells incubated with the cancer cells. FIG. 55F is a FACS scan showing a positive increase in fluorescently labeled granzyme B for huMNC2-CAR44 T cells incubated with the cancer cells. FIG. 55G is a graph of the mean fluorescent intensity. FIG. 55H is an xCELLigence scan tracking the real-time killing of DU145 cancer cells by huMNC2-CAR44 T cells (blue trace) but not by untransduced T cells (green). FIGS. 56A-56H show the cytotoxic effect of huMNC2-CAR44 T cells on MUC1* positive CAPAN-2 pancreatic cancer cells as measured by a variety of assays. FIG. 56A is a fluorescent photograph of untransduced T cells co-cultured with the pancreatic cancer cells, wherein granzyme B is stained with a red fluorophore. FIG. 56B is the DAPI and granzyme B merge. FIG. 56C is a fluorescent photograph of huMNC2-CAR44 T cells co-cultured with the pancreatic cancer cells, wherein granzyme B is stained with a red fluorophore. FIG. 56D is the DAPI and granzyme B merge. FIG. 56E is a FACS scan for fluorescently labeled granzyme B for untransduced T cells incubated with the cancer cells. FIG. 56F is a FACS scan showing a positive increase in fluorescently labeled granzyme B for huMNC2-CAR44 T cells incubated with the cancer cells. FIG. 56G is a graph of the mean fluorescent intensity. FIG. 56H is an xCELLigence scan tracking the real-time killing of CAPAN-2 cancer cells by huMNC2-CAR44 T cells (blue trace) but not by untransduced T cells (green). FIGS. 57A-57C show xCELLigence scans tracking the real-time killing of MUC1* positive cancer cells, but not MUC1* negative cells, by huMNC2-CAR44 T cells. FIG. 57A shows that huMNC2-CAR44 T cells effectively kill HCT colon cancer cells that have been stably transfected with MUC1*. FIG. 57B shows that huMNC2-CAR44 T cells have almost no effect on HCT-MUC1-41TR, which is a MUC1 negative cancer cell that has been stably transfected with a MUC1 full-length. In this cell line only about 10% of the cell have MUC1 cleaved to MUC1*. FIG. 57C shows that huMNC2-CAR44 T cells have no effect on HCT-116 cells, which is a MUC1 negative colon cancer cell line.

These data demonstrate that T cells transduced with a CAR wherein the antibody fragment targeting head is MNC2, effectively kill MUC1* positive cancer cells. These data specifically show that huMNC2-scFV-CAR44 transduced into human T cells effectively kill MUC1* positive cancer cells. Because we and others have now demonstrated that the most important aspect of CAR T function is the targeting antibody fragment, it follows that an immune cell or a T cell transduced with any CAR having the antibody fragment MNC2-scFV or huMNC2-scFV would have similar efficacy against MUC1 or MUC1* positive tumors. For example, the hinge region that connects the scFv to the transmembrane portion could be any flexible linker. The intracellular co-stimulatory domains could be CD28-3zeta, CD28-4-1BB-3zeta or any combination of immune cell co-stimulatory domains.

FIG. 61 shows an experiment in which huMNC2-scFv-CAR44 transduced human T cell that were bead stimulated (Protocol 1) or cancer cell stimulated (Protocol 2) were tested for their ability to inhibit tumor growth in animals. Human cancer cells that had been stably transfected with Luciferase were injected into female NOD/SCID/GAMMA (NSG) mice between 11 and 15 weeks of age. 500,000 BT-20 breast cancer cells were injected sub-cutaneously into a rear flank. Tumor engraftment was verified by injecting the animals with Luciferin and then imaging the fluorescent cancer cells using an IVIS instrument. IVIS images taken Day 5 post implantation showed the presence of tumor cells. On Day 6 after IVIS measurement, animals were given a one-time injection of 10 million of either human T cells transduced with huMNC2-scFv-CAR44 or untransduced T cells. 5 million T cells were injected intra-tumor and 5 million were injected into the tail vein. 10 minutes prior to IVIS photographs, mice were IP injected with Luciferin, which fluoresces after cleavage by Luciferase, thus making tumor cells fluoresce. FIGS. 61A, 61D, 61G show photographs of mice that were treated with huMNC2-scFv-CAR44 T cells that had been pre-stimulated by co-culturing for 24 hours with 4 μm beads to which was attached a synthetic MUC1*, PSMGFR peptide 24 hours prior to administration, "Protocol 1". FIGS. 61B, 61E, 61H show photographs of mice that were treated with huMNC2-scFv-CAR44 T cells that had been pre-stimulated by twice co-culturing for 24 hours with MUC1* positive cancer cells 24 hours prior to administration, "Protocol 2". As can be seen in FIG. 61, huMNC2-CAR44 T cells that were peptide-bead stimulated inhibited tumor growth better than cells pre-stimulated by incubation with live cancer cells, which likely contaminated the target cells and increased the tumor volume.

huMNC2-scFv-CAR44 transduced human T cell that were bead stimulated (Protocol 1) or cancer cell stimulated (Protocol 2) were also tested for their ability to inhibit tumor growth in animals. Human cancer cells that had been stably transfected with Luciferase were injected into female NOD/SCID/GAMMA (NSG) mice between 11 and 15 weeks of age. In another experiment, 500,000 BT-20 MUC1* positive triple negative breast cancer cells were injected sub-cutaneously into a rear flank. Tumor engraftment was verified by injecting the animals with Luciferin and then imaging the fluorescent cancer cells using an IVIS instrument. IVIS images taken Day 6 post implantation showed the presence of tumor cells. On Day 6, after IVIS imaging, 10M huMNC2-scFv-CAR44 T cells were administered to the animals. 5M of the CAR T cells were administered by intratumor injection and the other 5M were administered by tail vein injection. Control group was injected by same administration routes with the same number of untransduced T cells. IVIS measurements of tumor burden were taken on Days 6, 8, and 12. As can be seen in FIGS. 61A-61J, both groups of mice treated with huMNC2-CAR44 T cells showed a decrease in tumor burden compared to the control group.

huMNC2-scFv-CAR44 transduced human T cell that were bead stimulated (Protocol 1) were also tested for their ability to inhibit ovarian cancer growth in animals. Human SKOV-3 MUC1* positive ovarian cancer cells that had been stably transfected with Luciferase were injected into female NOD/SCID/GAMMA (NSG) mice between 11 and 15 weeks of age. In one experiment, 500,000 SKOV-3 cancer cells were injected into the intraperitoneal cavity to mimic metastatic ovarian cancer in humans. Tumor engraftment was verified by injecting the animals with Luciferin and then imaging the fluorescent cancer cells using an IVIS instrument. IVIS images taken Day 3 post implantation showed the presence of tumor cells. On Day 4 and Day 11, post tumor implantation, 10M huMNC2-scFv-CAR44 T cells were IP administered to the animals. On Day 4, CAR T cells were IP injected. On Day 11 half the CAR T cells were injected into the intraperitoneal space and the other half was injected into the tail vein. Control groups were injected by same administration routes with either the same number of untransduced T cells or same volume of PBS. Subsequent IVIS measurements of tumor burden were taken on Day 7, Day 10 and Day 15. As can be seen in FIGS. 62A-62L, control mice have tumors that are growing at a much faster rate than the huMNC2-CAR44 T cell treated mice. FIG. 62M shows the IVIS color bar correlating photons/second to color.

One aspect of the invention is a method for treating a patient diagnosed with, suspected of having, or at risk of developing a MUC1 positive or MUC1* positive cancer, wherein the patient is administered an effective amount of immune cells that have been transduced with a MUC1* targeting CAR, wherein the CAR is chosen from among the group consisting of MN-E6-CD8-CD28-3z (SEQ ID NOS: 297-298); MN-E6-CD4-CD28-3z (SEQ ID NOS: 748-749); MN-E6-CD8-41BB-3z (SEQ ID NOS: 300-301); MN-E6-CD4-41BB-3z (SEQ ID NOS: 750-751); MN-E6-CD8-CD28-41BB-3z (SEQ ID NOS: 303-304); MN-E6-CD4-CD28-41BB-3z (SEQ ID NOS: 754-755); MN-E6scFv-Fc-8-41BB-CD3z (SEQ ID NOS: 310-311); MN-E6scFv-IgD- Fc-8-41BB-CD3z (SEQ ID NOS: 770-771); MN-E6scFv-FcH-8-41BB-CD3z (SEQ ID NOS: 315-316); MN-E6scFv-IgD-FcH-8-41BB-CD3z (SEQ ID NOS: 772-773); MN-E6scFv-Fc-4-41BB-CD3z (SEQ ID NOS: 318-319); MN-E6scFv-FcH-4-41BB-CD3z (SEQ ID NOS: 321-322); MN-E6scFv-IgD-8-41BB-CD3z (SEQ ID NOS: 323-324); MN-E6scFv-IgD-4-41BB-CD3z (SEQ ID NOS: 327-328); MN-E6scFv-X4-8-41BB-CD3z (SEQ ID NOS: 330-331); MN-E6scFv-X4-4-41BB-CD3z (SEQ ID NOS: 333-334); MN-E6scFv-8-4-41BB-CD3z (SEQ ID NOS: 336-337), or any of the aforementioned CARs wherein the MN-E6 is replaced by fragment derived from MNC2, MNE6, 20A10, 3C2B1, 5C6F3, 25E6, 18G12, 28F9, 1E4, B12, B2, B7, B9, 8C7F3, or H11. Another aspect of the invention is a method for treating a patient diagnosed with, suspected of having, or at risk of developing a cancer, wherein the patient is administered an effective amount of immune cells that have been transduced with one of the aforementioned CARs wherein the MN-E6 is replaced by a peptide comprising antibody variable domain fragments that are specific for a cancer antigen. In any of the above methods, the immune cell may be a T cell and may further be isolated from the patient to be treated.

Other MUC1 Cleavage Sites

It is known that MUC1 is cleaved to the growth factor receptor form, MUC1*, on some healthy cells in addition to cancer cells. For example, MUC1 is cleaved to MUC1* on healthy stem and progenitor cells. A large percentage of bone marrow cells are MUC1* positive. Portions of the intestine are MUC1* positive.

The inventors have discovered that MUC1 can be cleaved at different positions that are relatively close to each other but the location of cleavage changes the fold of the remaining portion of the extracellular domain. As a result, monoclonal antibodies can be identified that bind to MUC1* cleaved at a first position but do not bind to MUC1* that has been cleaved at a second position. This discovery is disclosed in WO2014/028668, filed Aug. 14, 2013, the contents of which are incorporated by reference herein its entirety. We identified a set of anti-MUC1* monoclonal antibodies that bind to MUC1* as it appears on cancer cells but do not bind to MUC1* as it appears on stem and progenitor cells. Conversely, we identified a second set of monoclonal antibodies that bind to stem and progenitor cells but do not bind to cancer cells. One method used to identify stem specific antibodies is as follows: supernatants from monoclonal hybridomas were separately adsorbed onto 2 multi-well plates. Stem cells, which are non-adherent cells, were put into one plate and cancer cells which are adherent were put into an identical plate. After an incubation period, the plates were rinsed and inverted. If the non-adherent stem cells stuck to the plate, then the monoclonal antibody in that particular well recognizes stem cells and will not recognize cancer cells. Antibodies that did not capture stem cells or antibodies that captured cancer cells were identified as cancer specific antibodies. FACS analysis has confirmed this method works.

Antibodies MN-E6 and MN-C2 are examples of cancer-specific antibodies. Antibodies MN-C3 and MN-C8 are examples of stem-specific antibodies. Although both sets of antibodies are able to bind to a peptide having the PSMGFR sequence, FACS analysis shows that the anti-MUC1* polyclonal antibody and MN-C3 bind to MUC1* positive bone marrow cells but MN-E6 does not. The MUC1* polyclonal antibody was generated by immunizing a rabbit with the PSMGFR peptide. Similarly, MN-C3 binds to stem cells of the intestinal crypts but MN-E6 does not. Conversely, MN-E6 antibody binds to cancerous tissue while the stem-specific MN-C3 does not. Competition ELISA experiments indicate that the C-terminal 10 amino acids of the PSMGFR peptide are required for MN-E6 and MN-C2 binding, but not for MN-C3 and MN-C8. Therefore, another method for identifying antibodies that are cancer specific is to immunize with a peptide having the sequence of the PSMGFR peptide minus the 10 N-terminal amino acids or use that peptide to screen for antibodies or antibody fragments that will be cancer specific. Antibodies that bind to a peptide with a sequence of PSMGFR peptide minus the N-terminal 10 amino acids, referred to herein as N-10 peptide, but do not bind to a peptide with a sequence of PSMGFR peptide minus the C-terminal 10 amino acids, C-10 peptide, are cancer specific antibodies for use in the treatment or prevention of cancers.

The extracellular domain of MUC1 is also cleaved on stem cells and some progenitor cells, where activation of cleaved MUC1 by ligands NME1 in dimer form or NME7 promotes growth and pluripotency and inhibits differentiation. The transmembrane portion of MUC1 that remains after cleavage is called MUC1* and the extracellular domain is comprised essentially of the Primary Sequence of MUC1 Growth Factor Receptor (PSMGFR) sequence. However, the exact site of cleavage can vary depending on cell type, tissue type, or which cleavage enzyme a particular person expresses or overexpresses. In addition to the cleavage site that we previously identified which leaves the transmembrane portion of MUC1* comprising most or all of the PSMGFR (SEQ ID NO:2), other cleavage sites could possibly result in an extended MUC1* comprised of most or all of SNIKFRPGSVVVQLTLAFREGTINVHD-VETQFNQYKTEAASRY (SEQ ID NO:620); or SVVVQLTLAFREGTINVHDVETQFNQYKTEAASRY (SEQ ID NO:621).

To test this hypothesis, and to determine if antibodies to an N-terminally extended PSMGFR, would generated more cancer-specific antibodies than antibodies that bind to the PSMGFR, we generated monoclonal antibodies by immunization with peptides:

```
(PSMGFR)
                              (SEQ ID NO: 2)
GTINVHDVETQFNQYKTEAASRYNLTISDVSVSDVPFPFSAQSGA, (N+20/C-27)
                              (SEQ ID NO: 822)
SNIKFRPGSVVVQLTLAFREGTINVHDVETQFNQYKTE,
or (N+9/C-9)
                              (SEQ ID NO: 824)
VQLTLAFREGTINVHDVETQFNQYKTEAASRYNLTISDVSVSDVP
```

Monoclonal antibodies generated from immunization with the same peptide can also show differences in reactivity to the same cancerous tissue specimen. These results indicate that the monoclonal antibodies recognize different conformations of the truncated MUC1 extra cellular domain produced by immunizing with different length peptides, mimicking different cleavage sites, or from cleavage at different sites in the host animal. Antibodies that recognize different cleavage site conformations may be cancer sub-type specific or patient specific, depending on which cleavage enzyme their tumor expresses. In one aspect of the invention, a patient diagnosed with a certain type of cancer is treated with an antibody of the invention that recognizes a cleaved MUC1 wherein the antibody is specific for cleavage by a specific enzyme that is known to be typically expressed by that sub-type of cancer. In another aspect, a patient tumor is analyzed to determine which enzyme his or her tumor expresses and an antibody that recognizes a MUC1 cleaved by that enzyme is then administered to the patient for the treatment of their cancer. The antibody may be in the form of a CAR, a BiTE, an ADC, or a bispecific antibody.

We previously reported that it is the MUC1 transmembrane cleavage product, called MUC1* (muk1 star), that mediates tumor growth and not full-length MUC1 (Mahanta et al 2008). MUC1* is a growth factor receptor that is activated by ligand induced dimerization of its short extra cellular domain (FIG. 1A). Dimerization of the MUC1* extra cellular domain activates the MAP kinase signaling cascade and stimulates growth and survival of cancer cells (Fessler et al 2009). Bivalent antibodies that dimerize the MUC1* extra cellular domain stimulate cancer cell growth while the monovalent Fab of the same antibody, which cannot dimerize, inhibits cancer cell growth. We demonstrated this in vitro (FIG. 1B) and in vivo (FIG. 7A-7B).

We then identified the natural ligands that dimerize and activate MUC1* growth factor receptor function. Dimers of NME1 bind to and dimerize the MUC1* extra cellular domain and stimulate growth (FIG. 1C and Smagghe et al 2013). NME1 can turn its growth factor properties off. NME1 is secreted by MUC1* positive cells. Dimeric NME1 binds to MUC1* to stimulate growth. However, as the cell population grows, more and more NME1 is secreted from the cells. At high concentrations, the NME1 dimers multimerize and form hexamers, which do not bind to MUC1*, but likely bind to some unknown receptor, as the addition of NME1 hexamers turns off growth. NME1 is an adult form. The embryonic form is $NME7_{AB}$ (Carter et al 2016). Each $NME7_{AB}$ monomer has two binding sites for MUC1* so as a monomer it dimerizes MUC1* (FIG. 1D), stimulates growth and cannot turn itself off. In the developing embryo, BRD4 turns off NME7 and its co-factor JMJD6 turns on the self-regulating form, NME1. However, in cancers, NME7, which should be silenced in adult life, is aberrantly expressed again, where is renders the MUC1* growth factor receptor constitutively active.

In vitro, NME1 (SEQ ID NO:4) and $NME7_{AB}$ (SEQ ID NO:827) bind to the PSMGFR portion of the MUC1* extra cellular domain. Both growth factors can bind to the PSMGFR peptide (SEQ ID NO:2) even if the 10 N-terminal amino acids are deleted, referred to herein as N-10 (SEQ ID NO:3). However, neither NME1 nor $NME7_{AB}$ can bind to the PSMGFR peptide if the 10 membrane proximal amino acids are deleted (FIG. 2A-2D), referred to herein as C-10 (SEQ ID NO:825). In summary, the epitope to which NME1 and $NME7_{AB}$ bind includes all or part of the 10 membrane proximal amino acids: PFPFSAQSGA (SEQ ID NO:1743). We tested various antibodies that were generated in animals by immunizing with the PSMGFR peptide for their ability to recognize cancer cells but not healthy cells. Among the most cancer selective were the MNC2 and MNE6 monoclonal anti-MUC1* antibodies. Two other monoclonal antibodies that were generated from immunizing animals with the PSMGFR peptide are MNC3 and MNC8. Although MNC2, MNE6, MNC3 and MNC8 all bind to the PSMGFR peptide, like NME1 and $NME7_{AB}$, MNC2 and MNE6 bind strongly to the N-10 peptide but not to the C-10 peptide (FIG. 2B-2C). In fact, MNC2 and MNE6 competitively inhibit the binding of NME1 and $NME7_{AB}$ to PSMGFR (FIG. 3A-3C). Conversely, MNC3 and MNC8 bind to the C-10 peptide, bind less well to the N-10 peptide and do not compete with NME1 nor NME7$_{AB}$ for binding to MUC1* peptides, including PSMGFR (FIG. 2E-2F). MNC3 and MNC8 are far less cancer specific than MNC2 and MNE6. MNC3 and MNC8 recognize stem and progenitor cells, such as hematopoietic stem cells, whereas MNC2 and MNE6 do not (FIG. 39-41). Because hematopoietic stem cells are the progenitor cells for the blood cells, it would be problematic to have a cancer therapeutic that would also target such an important normal cell type.

Because MUC1* is generated by enzymatic cleavage of MUC1, we researched which cleavage enzymes cleave MUC1 to a MUC1* and whether or not we could identify antibodies that would recognize a MUC1* generated by a first cleavage enzyme but not MUC1* generated by a second cleavage enzyme. We found that MNC2 and MNE6 recognized a MUC1* generated by cleavage of MUC1 by MMP9 but not by cleavage by other enzymes such as MMP2 (FIG. 37 and FIG. 75). We note that MMP9 is overexpressed in cancers and is a predictor of poor prognosis (vant Veer et al 2002; Dufour et al 2011) and has been implicated in metastasis (Owyong et al, 2019), whereas MMP2 is expressed in bone marrow. One antibody binding to a MUC1* generated by cleavage by a first enzyme but not by cleavage by a second enzyme implies that the antibody recognizes a conformational epitope rather than a linear epitope.

We reasoned that the most cancer specific antibodies would be those antibodies that are characterized by some combination of most or all of the following:

Antibody binds to PSMGFR peptide;

Antibody does not bind to full-length MUC1;

Antibody binds to N-10;

Antibody does not bind to C-10;

Antibody competitively inhibits binding of NME1 or NME7$_{AB}$ to MUC1* extra cellular domain or a PSMGFR peptide;

Antibody recognizes a MUC1* generated by cleavage by MMP9;

Antibody recognizes a conformational epitope not a linear epitope.

MNC2 and MNE6 are Cancer Specific.

Our experiments show that both MNC2 and MNE6: a) Bind to tumor cells; b) monovalent forms block tumor growth in vitro and in vivo; c) have minimal to no binding of normal tissue while having robust binding to a wide panel of tumor tissues; d) when incorporated into CAR T cells, MNC2 and MNE6 directed CAR T cells do not recognize full-length MUC1 and do not kill cells that only express full-length MUC1; e) MNC2 and MNE6 directed CAR T cells cluster then kill tumor cells expressing MUC1*; and f) MNC2 and MNE6 recognize a MUC1 cleavage product when it is cleaved by MMP9.

MNC2 directed CAR T cells do not recognize normal, healthy cells that are MUC1* positive. A panel of normal cell lines, as well as primary cells, were co-cultured with huMNC2-CAR44 T cells. The normal cell populations were analyzed to determine whether or not the MNC2 directed CAR T cells killed them. The CAR T cells were analyzed to see if co-culture with the MUC1 positive normal cells activated the killing function of the CAR T cells, as measured by secretion of IL-2 or interferon gamma. As FIGS. 50-52 show, the MNC2 directed CAR T cells did not kill the normal cells, nor was there cytokine secretion, indicative of T cell activation. In addition, over 2,000 human tissue specimens were analyzed. The results showed that neither MNC2 nor MNE6 showed any significant binding to normal tissues but showed robust staining of a wide panel of cancerous tissues. For example, MNC2 stained 93% breast cancer specimens, 83% ovarian, 78% pancreatic and 71% lung cancer specimens. In addition, patient-matched primary tumors (FIG. 54) and subsequent metastases showed that the amount of MNC2-reactive MUC1* increased with tumor progression and metastases. In summary, MNC2 is a highly cancer specific antibody.

Characterization of MNC2 and MNE6

Our gold standard, cancer-specific antibodies MNC2 and MNE6: 1) bind to N-10 peptide but not to the C-10 peptide; 2) compete with NME7$_{AB}$ and dimeric NME1 for the same binding site near the C-terminus of the PSMGFR peptide, which is the membrane proximal portion of MUC1* on cells; 3) do not work in a Western blot assay indicating that they recognize a conformational rather than linear epitope; 4) recognize a MUC1* generated when MUC1 is cleaved by MMP9; 5) do not bind to full-length MUC1 but only to the cleaved form, MUC1*, in model cell lines as well as cancer cell lines; 6) show little to no binding to normal tissues but robustly stain a wide variety of tumor tissues; and 7) share some consensus sequences in their Complementarity Determining Regions, CDRs.

In an effort to identify other antibodies that are highly cancer-specific, like MNC2 and MNE6, we subjected new antibodies to a set of seven (7) characterization experiments: 1) epitope binding assays; 2) functional assays such as the ability to displace activating growth factor NME7$_{AB}$ or dimeric NME1 from binding to MUC1* peptides PSMGFR or N-10; 3) Western blots to determine whether or not the antibodies recognized a linear epitope versus a conformational epitope, in which case the antibodies would not work in a Western; 4) binding assays to see if the antibodies recognized a cleaved MUC1 that was dependent on cleavage by MMP9; 5) FACS analysis to measure the ability of the antibodies to recognize MUC1* positive cells but not full-length MUC1; and FACS analysis to measure the ability of the antibodies to recognize MUC1/MUC1* positive cancer cells; 6) immunohistochemistry, IHC, assays of normal tissues versus cancerous tissues to determine true cancer specificity; and 7) aligning antibody sequences to determine if subsets of antibodies shared consensus sequences that could predict their cancer specificity or lack thereof.

Monoclonal antibodies were produced by immunizing animals with peptides derived from a MUC1 that is devoid of tandem repeats. These antibodies included PSMGFR and peptides that were extended at the N-terminus of PSMGFR. Immunizing peptides were:

PSMGFR (SEQ ID NO:2))

N+9/C-9 (9 amino acids added onto the N-terminus and 9 amino acids deleted from the C-terminus) (SEQ ID NO:824)

N+20/C-27 (20 amino acids added onto the N-terminus and 27 amino acids deleted from the C-terminus) (SEQ ID NO:823)

These monoclonal antibodies were then tested to determine which satisfied the seven (7) characterization criteria cited above, which we reasoned would identify the most cancer specific antibodies.

Epitope Binding Assays

ELISA assays were performed to determine if, in addition to recognizing their immunizing peptide, they recognized PSMGFR, N-10 or C-10. In addition, they were tested for their ability to bind to N+20/C-27, N+9/C-9. We first did the ELISA assay on our set of reference antibodies, MNC2, MNE6, which we know are cancer-specific plus MNC3, which we know recognizes stem cells and progenitor cells (FIG. 63A-63B). None of the reference antibodies bound to the N+20/C-27 peptide. MNC2 and MNE6 cannot bind to PSMGFR peptides with 27, 10 or 9 C-terminal deletions, however, MNC3 binds to C-10 and to N+9/C-9 peptides.

This same ELISA assay was performed on the antibodies of the invention (FIG. 64-66 and FIG. 201). The binding patterns of the antibodies that were generated by immunizing with the PSMGFR peptide are shown in FIG. 64A-64B. Note that only 20A10 exactly matches the binding profile of MNC2 and MNE6. 25E6, 28F9 and 18G12 are all able to bind to the N-10 peptide. 18B4 is the only antibody raised against the PSMGFR peptide that requires the 10 most N-terminal amino acids of the peptide. The color of the bars for each antibody in the ELISA graph are color coded to match the deductive cognate sequence, or a portion thereof, of that antibody. In addition, another set of antibodies was assayed by ELISA (FIG. 201). Of this set, B12, B2, B7, B9, 8C7F3, and H11 bound to the PSMGFR peptide, bound to the N-10 peptide, but not to the C-10 peptide (FIG. 201). The binding patterns of the antibodies that were generated by immunizing with the N+20/C-27 peptide are shown in FIG. 65A-65B. Although these antibodies were raised against the N+20/C-27 peptide, all but one, 45C11, still bind to the PSMGFR peptide, albeit at the N-terminal portion of PSMGFR. The binding of 45C11 is weak but deductive reasoning shows that all or some of the cognate epitope must lie within SNIKFRPGSVV (SEQ ID NO: 1744).

Of the antibodies generated by immunizing with the N+9/C-9 peptide, 8A9 and 17H6 do not bind to the PSMGFR peptide, so must bind to the 9 additional N-terminal amino acids. Antibodies 3C5 and 39H5 appear to bind to the 10 most N-terminal amino acids of the PSMGFR peptide.

In order to further refine the epitopes to which each antibody binds, a series of smaller peptides derived from the PSMGFR sequence were synthesized: N-30 (SEQ ID NO:7), N-26 (SEQ ID NO:6), N-19 (SEQ ID NO:4), N-10/C-5 (SEQ ID NO:8), N-19/C-5 (SEQ ID NO: 9). Each of the antibodies was tested in an ELISA assay for their ability to bind to this refined set of peptides, plus PSMGFR, N-10 and C-10 peptides (FIG. 67-69).

In FIG. 67A-67D, antibodies generated by immunization with the PSMGFR peptide were assayed. As can be seen in the figure, amino acids ASRYNLT (SEQ ID NO:1745), which are essentially in the middle of the PSMGFR peptide, are important or essential for the binding of 28F9, 18G12, 25E6, and MNC3 antibodies. Amino acids GTINVHDVET (SEQ ID NO:1746), which comprise the most N-terminal part of the PSMGFR peptide are important or essential for the binding of the 18B4 antibody. Amino acids FPFS (SEQ ID NO:1747) are important or essential for the binding of 20A10, MNC2 and MNE6. We note that these three antibodies recognize a conformational epitope, not a linear epitope. Because the proline in the FPFS (SEQ ID NO: 1747) sequence significantly alters the conformation of nearby portions of the PSMGFR peptide, it is also possible that the antibodies do not bind directly to these four amino acids, but that the absence of the proline alters the fold of the remaining peptide such that the conformation to which 20A10, MNC2 and MNE6 bind, is no longer present.

In FIG. 68A-68D, antibodies generated by immunization with the N+20/C-27 peptide were assayed. As can be seen in the figure, amino acids GTINVHDVET (SEQ ID NO: 1746), which comprise the most N-terminal part of the PSMGFR peptide are important or essential for the binding of the 29H1, 32C1, and 31A1 antibodies. Amino acids SNIKFRPGSVVVQLTLAFRE (SEQ ID NO:1748), which is 20 additional amino acids N-terminal to the PSMGFR peptide and outside of the PSMGFR peptide, are important or essential for the binding of antibody 45C11. However, referring back to FIG. 65, antibody 45C11 was not able to bind to the N+9/C-9 peptide, therefore we conclude that amino acids within the SNIKFRPGSVV sequence (SEQ ID NO: 1744) are essential for the binding of 45C11. Amino acids QFNQYKTEA (SEQ ID NO:1749), which are still within the sequence of PSMGFR, are important or essential for the binding of antibody 1E4.

In FIG. 69A-69D, antibodies generated by immunization with the N+9/C-9 peptide were assayed. As can be seen in the figure, amino acids GTINVHDVET (SEQ ID NO: 1746), which comprise the most N-terminal part of the PSMGFR peptide are important or essential for the binding of the 39H5 and 3C5 antibodies. As can be seen in the figure, amino acids VOLTLAFRE (SEQ ID NO:1750), which is 9 additional amino acids N-terminal to the PSMGFR peptide and outside of the PSMGFR peptide, are important or essential for the binding of antibodies 17H6 and 8A9. Because the 17H6 and 8A9 antibodies do not bind to any of the smaller peptides shown in this figure, refer to FIG. 66A-66C, which shows that these two antibodies only bind to the peptide that has 9 additional amino acids N-terminal to the PSMGFR peptide.

Table 2 below lists antibodies of the invention and their cognate epitopes.

TABLE 2

| Immunizing Peptide | Antibody Name | Cognate Sequence |
|---|---|---|
| PSMGFR | MNC2 | FPFS (SEQ ID NO: 1747) or PFPFSAQSGA (SEQ ID NO: 1743) |
| | MNE6 | FPFS (SEQ ID NO: 1747) or PFPFSAQSGA (SEQ ID NO: 1743) |
| | 20A10 | FPFS (SEQ ID NO: 1747) or PFPFSAQSGA (SEQ ID NO: 1743) |
| | 3C2B1 | FPFS (SEQ ID NO: 1747) or PFPFSAQSGA (SEQ ID NO: 1743) |
| | 5C6F3 | SVSDV (SEQ ID NO: 1751) |
| | MNC3 | ASRYNLT (SEQ ID NO: 1745) |
| | 25E6 | ASRYNLT (SEQ ID NO: 1745) |
| | 28F9 | ASRYNLT (SEQ ID NO: 1745) |
| | 18G12 | ASRYNLT (SEQ ID NO: 1745) |
| | 18B4 | GTINVHDVET (SEQ ID NO: 1746) |
| N+20/C-27 | 45C11 | SNIKFRPGSVV (SEQ ID NO: 1744) |
| | 29H1 | GTINVHDVET (SEQ ID NO: 1746) |
| | 32C1 | GTINVHDVET (SEQ ID NO: 1746) |
| | 31A1 | GTINVHDVET (SEQ ID NO: 1746) |
| | 1E4 | QFNQYKTEA (SEQ ID NO: 1749) |
| N+9/C-9 | 17H6 | VQLTLAFRE (SEQ ID NO: 1750) |
| | 8A9 | VQLTLAFRE (SEQ ID NO: 1750) |
| | 39H5 | GTINVHDVET (SEQ ID NO: 1746) |
| | 3C5 | GTINVHDVET (SEQ ID NO: 1746) |

Ability to Displace NME7$_{AB}$ Binding to the MUC1* Extra Cellular Domain Peptide Psmgfr We previously reported that dimeric NME1 dimerizes MUC1* extra cellular domain and stimulates growth. Monomeric NME7$_{AB}$ has two binding sites for MUC1* so that as a monomer it dimerizes MUC1* and mediates cancer cell growth. We showed that NME1 and NME7$_{AB}$ can bind to the MUC1* extra cellular domain. In vitro, NME1 and NME7$_{AB}$ bind to the PSMGFR peptide even if the 10 N-terminal amino acids are deleted, referred to herein as N-10 (SEQ ID NO:3). However, neither NME1 nor NME7$_{AB}$ can bind to the PSMGFR peptide if the 10 membrane proximal amino acids are deleted, referred to herein as C-10 (SEQ ID NO:825). In summary, the epitope to which NME1 and NME7$_{AB}$ bind includes all or part of the 10 membrane proximal amino acids: PFPFSAQSGA (SEQ ID NO:1743). We tested various antibodies that were generated in animals by immunizing with the PSMGFR peptide for their ability to recognize cancer cells but not healthy cells. Among the most cancer selective were the MNC2 and MNE6 monoclonal anti-MUC1* antibodies. Two other monoclonal antibodies that were generated from immunizing animals with the PSMGFR peptide are MNC3 and MNC8. Although MNC2, MNE6, MNC3 and MNC8 all bind to the PSMGFR peptide, like NME1 and NME7$_{AB}$, MNC2 and MNE6 bind strongly to the N-10 peptide but not to the C-10 peptide. In fact, MNC2 and MNE6 competitively inhibit the binding of NME1 and NME7$_{AB}$ to PSMGFR. Conversely, MNC3 and MNC8 are able to bind to the C-10 peptide, bind less well to the N-10 peptide and do not compete with NME1 nor NME7$_{AB}$ for binding to MUC1* peptides, including PSMGFR (FIG. 70). MNC3 and MNC8 are less cancer specific than MNC2 and MNE6. MNC3 and MNC8 recognize stem and progenitor cells, such as hematopoietic stem cells, whereas MNC2 and MNE6 do not. Because hematopoietic stem cells are the progenitor cells for the blood cells, it would be problematic to have a cancer therapeutic that would also target such an important normal cell type.

In this experiment, antibodies of the invention were tested for their ability to displace NME7$_{AB}$ from binding to the PSMGFR peptide. In this experiment, a multi-well plate was coated with the PSMGFR peptide. Recombinant NME7$_{AB}$ was allowed to bind to the surface-immobilized PSMGFR peptide. Wash steps followed. Various antibodies were added, followed by wash steps. The amount of NME7$_{AB}$ that remained attached to the PSMGFR coated plate, after antibody competition, was measured by detecting a tag on the NME7$_{AB}$. As a control, anti-NME7$_{AB}$ antibodies were also tested for their ability to displace NME7$_{AB}$ from the PSMGFR. FIG. 70 shows a graph of an ELISA displacement assay. The bar graph is color coded to indicate the cognate epitope to which each antibody binds. As can be seen in the figure, the antibodies that bind to the more C-terminal portions of PSMGFR are the most potent at disrupting the binding of onco-embryonic growth factor NME7$_{AB}$ to the MUC1* extra cellular domain or the PSMGFR peptide. The rank order of potency for disrupting binding of NME7$_{AB}$ to PSMGFR according to their cognate epitope is as follows: FPFS (SEQ ID NO: 1747)>ASRYNLT (SEQ ID NO: 1745)>QFNQYKTEA (SEQ ID NO: 1749)>GTINVHDVET (SEQ ID NO: 1746). Antibodies that bind to epitopes outside of the PSMGFR peptide, such as 45C11, 8A9 and 17H6 did not compete with NME7$_{AB}$ for binding.

Western Blot Assay to Determine Linear Versus Conformational Cognate Epitope

Antibodies were tested to determine whether they recognize a linear or a conformational epitope. Only antibodies that recognize a linear epitope work in Western blots when using denaturing gels. For comparison, known antibodies were tested for their ability to bind to HCT-116, a MUC1 negative cancer cell line, HCT-MUC1-18, which is a cleavage resistant clone of HCTs transfected with full-length MUC1, and HCTs transfected with MUC1*, wherein the extra cellular domain comprises only the PSMGFR sequence. The antibodies tested for comparison are MNC2 and MNE6, which were known to only recognize a conformational epitope, SDIX which is a polyclonal antibody raised against PSMGFR and VU4H5, which is a commercially available monoclonal antibody that recognizes the tandem repeats of full-length MUC1 (FIG. 71A-71D). As can be seen, neither MNC2 nor MNE6 recognize a MUC1 or MUC1* specific linear epitope. The SDIX polyclonal antibody recognizes HCT-MUC1* but not full-length MUC1 and VU4H5 only recognizes full-length MUC1. These same antibodies were also tested for their ability to work in Western blots of two breast cancer cell lines 1500, aka Zr-75-1, and T47D cells and show the same binding pattern (FIG. 71E-71H).

Antibodies that were raised against the PSMGFR peptide were tested the same way in Western blots (FIG. 72A-72P). As can be seen, antibodies 25E6 and 18B4 recognize linear epitopes but 20A10, 3C2B1, 5C6F3, 18G12 and 28F9 do not, indicating that they bind to a conformational epitope. Antibodies that were raised against the N+20/C-27 peptide were tested the same way in Western blots (FIG. 73A-73J). As can be seen, antibodies 31A1 and 32C1 recognize linear epitopes. Antibodies 1E4 and 45C11 may recognize a conformational epitope. Antibodies that were raised against the N+9/C-9 peptide were tested the same way in Western blots (FIG. 74A-74H). As can be seen, none of these antibodies recognize linear MUC1 or MUC1* specific epitopes. These antibodies may recognize a conformational epitope. However, an alternative interpretation is that the lack of binding in a Western blot means that they do not specifically recognize MUC1 or a MUC1 cleavage product or that the concentration used in this assay was insufficient.

Recognition of a MUC1 Cleavage Product after Cleavage by MMP9

We previously demonstrated that MNC2 recognizes a MUC1* that is generated when full-length MUC1 is cleaved by matrix metalloprotease 9, MMP9 (FIG. 37). MMP9 is expressed by tumor tissues and is a predictor of poor prognosis for breast cancers (vant Veer et al 2002; Dufour et al 2011). MMP9 has also been implicated in metastasis (Owyong et al 2019). Recall also that MNC2 competitively inhibits the binding of onco-embryonic growth factor NME7$_{AB}$ to the MUC1* extra cellular domain (FIG. 3). Therefore, it follows that onco-embryonic growth factor, which activates growth and survival functions of MUC1*, also recognizes a MUC1* generated by cleavage by MMP9. It then follows that the most cancer specific antibodies are those that recognize a conformational epitope formed when MUC1 is cleaved to MUC1* by MMP9.

Antibodies generated by immunization with PSMGFR, N+20/C-27, or N+9/C-9 were tested for their ability to recognize MUC1 after it is cleaved by MMP9. To do this, we transfected HCT-116, a MUC1 negative colon cancer cell line, with full-length MUC1 and isolated a single cell clone that is cleavage resistant; this cleavage resistant cell line is called HCT-MUC1-18. To HCT-MUC1-18 cells was added either a catalytically active MMP9 or MMP2. The enzymes, added over a range of concentrations, were incubated with the cells for 24 hours. The resultant cells were then incubated with the various antibodies and analyzed by FACS to determine which bound to a MUC1 cleavage product produced by cleavage by MMP9 (FIG. 75A-75N). Note that the first bar of each graph shows that none of the antibodies binds to full-length MUC1 in the absence of cleavage. Each bar graph is labeled with both the name of the antibody used in that assay and its cognate epitope. The order of the graphs from right to left corresponds to the distance from the cell surface of the antibody's cognate epitope. The antibodies that bind to the more C-terminal epitopes within PSMGFR peptide, such as 20A10 and 25E6, showed the most increased binding to a MUC1 cleavage product after cleavage by MMP9 but not MMP2. Antibody 45C11, which binds to the SNIKFRPGSVV (SEQ ID NO: 1744) epitope, which is outside of the PSMGFR portion of MUC1, does not recognize a MUC1 cleavage product after cleavage by MMP9 or MMP2 (FIG. 75K). Similarly, antibodies 8A9 and 17H6 bind to the VOLTLAFRE (SEQ ID NO: 1750) epitope, which is also outside of the PSMGFR sequence, and they do not bind to a MUC1 cleaved by MMP9 or MMP2. This result is consistent with the idea that MMP9 cleaves MUC1 such that the extra cellular domain of the remaining transmembrane cleavage product comprises essentially the amino acids of the PSMGFR peptide. For the greatest degree of cancer specificity, the antibody should recognize a conformational epitope of a MUC1 cleavage product created when MUC1 is cleaved by MMP9. Of the antibodies shown in FIG. 75A-75N, only 20A10 recognizes the MUC1 cleavage product produced by cleavage by MMP9 and also does not work in a Western blot, indicating it recognizes a conformational epitope, as do MNC2 and MNE6. Cleavage and release of the massive tandem repeat domain of MUC1 unmasks the ectopic binding site on MUC1*; linear epitopes will be unmasked in addition to conformational epitopes.

FACS Analysis of Binding to a Panel of Cancer Cell Lines

Fluorescence Activated Cell Sorting, FACS, was performed on reference antibodies as well as new antibodies of the invention. FACS analyses of reference antibodies MNC2, "C2", and VU4H5 binding to either the MUC1-negative cell line HCT-116, HCTs transfected with MUC1*, "HCT-MUC1*", a cleavage resistant single cell clone of HCTs transfected with MUC1 full-length, "HCT-MUC1-18", and MNC2 binding to breast cancer cells line T47D or breast cancer cell line 1500 also known as ZR-75-1, was performed (FIG. 76A-76J). This analysis shows that MNC2 binds to an ectopic binding site on the extra cellular domain of MUC1*, which is only available after cleavage and release of the bulk of the extra cellular domain comprising the tandem repeat domain. VU4H5 binds to hundreds of repeating epitopes in the tandem repeat domain of full-length MUC1 and does not bind to MUC1*. Although we know that cancer cell lines express both full-length MUC1 and MUC1*, antibodies against full-length MUC1 have, as yet, been shown to have no therapeutic value. Stimuvax, ImMucin, IMGN242, SAR566658, PankoMab and AS1402 were all antibodies that bound to full-length MUC1 and all failed to show efficacy in clinical trials. MUC1*, and not full-length MUC1, is a potent growth factor receptor that mediates the growth of cancer cells (Mahanta et al 2008) and their resistance to chemotherapy agents (Fessler et al 2009). These studies showed that full-length MUC1 had no tumor promoting activity. Further, IHC studies show that as tumor stage increases, the amount of MUC1* increases as the amount of full-length MUC1 decreases (FIG. 54). In fact, studies with tissue micro arrays of breast cancers show that nearly 30% of breast cancer specimens had no detectable full-length MUC1, compared to only 5% that were negative for MUC1* (FIG. 10-11). A point to consider for therapeutics that target full-length MUC1 is that if cells expressing full-length MUC1 are eliminated, that would simply enrich the tumor population for the more virulent MUC1* growth factor receptor expressing cells, which would make the cancers worse.

Reference antibody MNC2, "C2", was analyzed by FACS for its ability to bind to a panel of cancer cell lines that are all MUC1* positive, with the exception of MDA-MB-231, which expresses MUC1 and MUC1* at a level that is so low that it is often used as a negative control (FIG. 77A-77N). The panel of cancer cells that was probed with MNC2 included T47D and 1500 breast cancer cells, NCI-H292 and NCI-H1975 lung cancer cells, SKOV-3 ovarian cancer cells, HPAF-II and Capan-1 pancreatic cancer cells, DU145 prostate cancer cells, and MDA-MB-231, breast cancer cells, which are nearly MUC1 and MUC1* negative. MNC2 robustly recognized a wide range of cancer cell lines. We note that although MNC2 recognized HPAF-II pancreatic cells, it did not recognize another pancreatic cell line, Capan-1, as well. Similarly, MNC2 did not recognize prostate cancer cell line DU145 very well. In IHC tissue studies, we found that MNC2 recognized about 57% of prostate cancer tissues and 78% of pancreatic tissues, albeit with significant tumor heterogeneity.

FIG. 78A-78C shows a color coded schematic of the PSMGFR sequence that has been extended or deleted at both the N- and C-termini. Antibodies of the invention were tested against this subset of peptides to further refine the epitopes to which each antibody binds or the critical amino acids within the epitope to which each antibody binds. FIG. 78A is an aligned schematic of the various subsets of peptides. FIG. 78B lists the antibodies that bind to each of the color coded sequences. FIG. 78C lists the cancer cell lines that each antibody recognizes.

FIGS. 80-87 show graphs of FACS analyses wherein antibodies of the invention are compared for their ability to specifically recognize different types of cancer cells. Percent cells recognized as well as the Mean Fluorescence Intensity, MFI, was measured. Considering only these FACS experiments, they show that only antibodies that recognize the PSMGFR peptide are able to recognize cancer cell lines. Antibodies that bind to epitopes outside of the PSMGFR sequence do not specifically recognize these cancer cell lines.

IHC Tissue Studies of Normal Versus Cancerous Tissues to Determine True Cancer specificity Immunohistochemistry, IHC, tissue studies of tissue micro arrays, "TMAs", are a more stringent test of the cancer specificity of antibodies than FACS analysis of a single cancer cell line. Cancer cell lines are a single cell from a single patient that have been expanded in a lab for decades. Cell lines are limited in that they are not representative of a cross section of the human population. Further, after culturing the cell line in vitro for decades it may no longer look like the original cell. Also, there are no real normal cell lines for comparison, as they have to be made immortal. Tissue studies are more informative because each tissue micro array comprises tissues from multiple donors and the cells are in their natural environment, without years of culturing under non-physiologic conditions. Additionally, tissues provide information regarding tumor heterogeneity as well as information regarding normal patterns of expression. Each antibody of the invention was used to probe a normal tissue micro array, FDA Normal Array 1021. In addition the antibody was also used to probe a panel of cancerous tissue arrays. In some cases, antibodies that showed strong staining of normal tissues, especially of critical organs such as heart or lung, were tested on a limited number of cancerous tissue arrays, since their cross reactivity to normal tissues eliminated them from consideration as anti-cancer therapeutics.

FIGS. 113-200 show photographs of the IHC staining of normal TMAs versus cancerous TMAs for each antibody of the invention.

FIG. 113-120 show photographs of tissues studies probed with antibody 20A10. Recall that 20A10 binds to the PSMGFR peptide, binds to the N-10 peptide, but does not bind to the C-10 peptide. Refined epitope mapping shows that like MNC2 and MNE6, the binding of 20A10 depends on amino acids FPFS (SEQ ID NO: 1747) being present in the PSMGFR peptide. 20A10 binds to the most membrane proximal part of the MUC1* extra cellular domain. An overview of FDA Normal Tissue Array 1021 is shown in FIG. 113. FIG. 114A-114X show that there is little to no cross reactivity of 20A10 for normal tissues. We note that MNC2, MNE6 and 20A10 all react with the MUC1* that is expressed on the luminal edge of the terminal breast ducts, luminal edge of the fallopian tubes, luminal edge of about 10% of the distal collecting ducts of normal kidney, and luminal edge of ureter. Because the staining is strictly limited to the luminal edge of a subset of ducts and glands, these antibodies are considered to be safe as therapeutics as the inside of ducts and glands are protected from large entities carried by blood, such as antibodies or CAR T cells. Importantly, MNC2, MNE6 and 20A10 show no staining of critical organs, such as heart, lung and brain. In stark contrast, 20A10, like MNC2 and MNE6, robustly binds to cancerous tissues. 20A10 stains nearly all specimens of the BR1141 breast cancer array (FIG. 115-116). In addition to robust staining of the breast cancer tissue, the staining is membrane staining, indicating that 20A10 recognizes an extra cellular portion of MUC1*, which is critical for an effective antibody-based anti-cancer therapeutic. 20A10 also showed robust and membranous staining of pancreatic cancer tissues (FIG. 117-118) and esophageal cancer tissues (FIG. 119-120). In summary, 20A10 shows great cancer specificity and as an anti-cancer therapeutic offers a large therapeutic window because of the vast difference between staining of normal tissues and cancerous tissues, in terms of the location and intensity of staining.

Anti-MUC1* antibody 3C2B1 is an antibody that like MNC2, MNE6 and 20A10, binds to N-10 but not to C-10. More refined epitope mapping shows that like these three other highly cancer-specific antibodies, 3C2B1 requires the FPFS sequence (SEQ ID NO: 1747) for binding to a MUC1* extra cellular domain peptide. FIG. 121 shows the photograph of the FDA normal array 1021. FIG. 122A-122X shows photographs of specific tissues from FDA normal tissue array 1021 stained with the anti-PSMGFR antibody 3C2B1 at 20 ug/mL. As can be seen, there is no binding of 3C2B1 to any critical normal organs. FIG. 123 shows photograph of pancreatic cancer tissue array PA1003 stained with the anti-PSMGFR antibody 3C2B1 at 1-20 ug/mL. FIG. 124 shows photographs of specific tissues from pancreatic cancer tissue array PA1003 stained with the anti-PSMGFR antibody 3C2B1 at 20 ug/mL. FIG. 125 shows photograph of breast cancer tissue array 1141 stained with the anti-PSMGFR antibody 3C2B1 at 20 ug/mL. FIG. 126A-126F shows magnified photographs of specific tissues from breast cancer tissue array 1141 stained with the anti-PSMGFR antibody 3C2B1 at 20 ug/mL. As can be seen in the figure, 3C2B1 robustly stains breast cancer tissues.

Anti-MUC1* antibody 5C6F3 binds to the N-10 peptide, does bind to the C-10 peptide, although binding is reduced somewhat. Its cognate epitope comprises all or some of the sequence SVSDV (SEQ ID NO:1751). FIG. 127 shows photograph of FDA normal tissue array 1021 stained with the anti-PSMGFR antibody 5C6F3 at 1 ug/mL. FIG. 128 shows photographs of specific tissues from FDA normal tissue array 1021 stained with the anti-PSMGFR antibody 5C6F3 at 1 ug/mL. FIG. 129 shows photograph of pancreatic cancer tissue array PA1003 stained with the anti-PSMGFR antibody 5C6F3 at 1-20 ug/mL. FIG. 130 shows photographs of specific tissues from pancreatic cancer tissue array PA1003 stained with the anti-PSMGFR antibody 5C6F3 at 1 ug/mL. FIG. 131 shows photograph of breast cancer tissue array 1141 stained with the anti-PSMGFR antibody 5C6F3 at 1 ug/mL. FIG. 132 shows photographs of specific tissues from breast cancer tissue array 1141 stained with the anti-PSMGFR antibody 5C6F3 at 1 ug/mL. As can be seen in the FIG. 5C6F3 is a high affinity antibody that has great cancer-specificity and with the exception of adrenal, which may be an artefact of that tissue, did not show binding to normal tissues.

In contrast to 20A10, which binds to the most membrane proximal part of the MUC1* extra cellular domain, 18B4 binds within the GTINVHDVET sequence (SEQ ID NO: 1746), which is the most distal part of the PSMGFR sequence. Unlike antibodies MNC2, MNE6 or 20A10, 18B4 cannot bind to the N-10 peptide but does bind to the C-10 peptide. FIG. 133-134 show the binding of antibody 18B4 to normal tissues. In contrast to 20A10, antibody 18B4 shows strong binding to a wide range of normal tissues (FIG. 134), including lung (FIG. 134K). FIG. 135-138 show 18B4 staining of breast cancer tissues and esophageal cancer tissues. Because of the strong binding of 18B4 to normal tissues, there is less cancer specificity to this antibody.

FIG. 139-144 show the binding of PSMGFR antibody 18G12 to normal tissues, breast cancer tissues and esophageal cancer tissues. 18G12 is able to bind to the N-10 peptide, but is also able to bind to the C-10 peptide. 18G12 binds to the ASRYNLT (SEQ ID NO: 1745) epitope within the PSMGFR peptide. Antibody 18G12 binds to the luminal edge of many of the collecting ducts of normal kidney (FIG. 140D), binds to normal heart muscle (FIG. 140I) as well as to normal skeletal muscle (FIG. 140X). However, there is a clear cancer specificity in that 18G12 binds much more strongly to cancerous tissues than to the few normal tissues. In addition, 18G12 stains the entire cancerous tissues rather than just a luminal edge here or there. FIG. 141-146 show 18G12 staining of breast cancer tissues, pancreatic cancer tissues and esophageal cancerous tissues. The contrast between the staining of the normal tissues and the cancer tissues clearly demonstrates cancer specificity.

FIG. 147-148 show the binding of PSMGFR antibody 25E6 to normal tissues. 25E6 is able to bind to the N-10 peptide, but is also able to bind to the C-10 peptide. 25E6 binds to the ASRYNLT (SEQ ID NO: 1745) epitope within the PSMGFR peptide. Like MNC2, MNE6 and 20A10, antibody 25E6 binds to the luminal edge of terminal breast ducts, luminal edge of fallopian tubes, to the luminal edge of a subset of the distal collecting ducts of normal kidney and to the luminal edge of ureter. Unlike MNC2, MNE6 and 20A10, 25E6 binds, albeit very weakly, to normal heart muscle (FIG. 148I) as well as to normal skeletal muscle (FIG. 148X). However, there is a clear cancer specificity in that 25E6 binds much more strongly to cancerous tissues than to the few normal tissues. In addition, 25E6 stains the entire cancerous tissues rather than just a luminal edge here or there. FIG. 149-152 show 25E6 staining of breast cancer tissues and pancreatic cancerous tissues. The contrast between the staining of the normal tissues and the cancer tissues clearly demonstrates cancer specificity.

FIG. 153-156 show the binding of PSMGFR antibody 28F9 to normal tissues and breast cancer tissues. 28F9 is able to bind to the N-10 peptide, but is also able to bind to the C-10 peptide. 28F9 binds to the ASRYNLT (SEQ ID NO: 1745) epitope within the PSMGFR peptide. Like MNC2, MNE6 and 20A10, antibody 25E6 binds to the luminal edge of terminal breast ducts, luminal edge of fallopian tubes, to the luminal edge of a subset of the distal collecting ducts of normal kidney and to the luminal edge of ureter. FIG. 155-156 show 28F9 staining of breast cancer tissues.

FIG. 157-158 show the binding of the N+20/C-27 antibody 1E4 to normal tissues. 1E4 is able to bind to the N-10 peptide but also is able to bind to the C-10 peptide. 1E4 binds to the QFNQYKTEA sequence (SEQ ID NO: 1749) which is within the PSMGFR sequence. Examination of the entire normal tissue micro array (FIG. 157A) shows that antibody 1E4 binds to many normal tissues, including brain, cerebellum, all 3 liver specimens, pancreas, parathyroid, spinal cord and skeletal muscle. Magnified images show that 1E4 stains heart (FIG. 158I) as well. 1E4 staining of a breast cancer array (FIG. 159-160) shows that there is some cancer specificity.

FIG. 161-162 show the binding of the N+20/C-27 antibody 29H1 to normal tissues. 29H1 binds within the GTINVHDVET sequence (SEQ ID NO: 1746), which is the most distal part of the PSMGFR sequence. Unlike antibodies MNC2, MNE6 or 20A10, 29H1 cannot bind to the N-10 peptide but does bind to the C-10 peptide. Examination of the entire normal tissue micro array (FIG. 157A) shows that even at concentration as low as 0.5 ug/mL, antibody 29H1 strongly stains a wide range of normal tissues, including brain, heart, liver and lung. 29H1 staining of a breast cancer array (FIG. 163-164) and staining of a pancreatic cancer tissue array (FIG. 165-166) shows that there is no cancer specificity.

Antibody 31A1 is similar to 29H1 in that they are both N+20/C-27 antibodies that bind within the GTINVHDVET (SEQ ID NO:1746) sequence, which is the most distal part of the PSMGFR sequence. Unlike antibodies MNC2, MNE6 or 20A10, neither 31A1 nor 29H1 can bind to the N-10 peptide but do bind to the C-10 peptide. Examination of the entire normal tissue micro array and the magnified images (FIG. 167-168) shows that even at concentration as low as 0.5 ug/mL, antibody 31A1 strongly stains a wide range of normal tissues, including brain, heart, lung, spleen, bone marrow, and skeletal muscle. 31A1 was used to stain a breast cancer array, (FIG. 169-170). 31A1 was used over a range of concentrations to stain a pancreatic cancer tissue array (FIG. 171-172). These figure shows that 31A1 has insufficient cancer specificity.

Antibody 32C1 is similar to 29H1 and 31A1 in that they are all N+20/C-27 antibodies that bind within the GTINVHDVET sequence (SEQ ID NO: 1746), which is the most distal part of the PSMGFR sequence. Unlike antibodies MNC2, MNE6 or 20A10, none of 32C1, 31A1 or 29H1 can bind to the N-10 peptide but all do bind to the C-10 peptide. Examination of the entire normal tissue micro array and the magnified images (FIG. 173-174) shows that even at concentration as low as 0.25 ug/mL, antibody 32C1 strongly stains a wide range of normal tissues, including brain, heart, lung, liver, spleen and bone marrow. 32C1 was also used to probe a breast cancer array (FIG. 175-176). 32C1 was used over a range of concentrations to stain an esophageal cancer tissue array (FIG. 177-178). Taken together, these figures show that 32C1 has insufficient cancer specificity.

Antibody 45C11 is an N+20/C-27 antibody that binds to epitope SNIKFRPGSVV (SEQ ID NO:1744) that is 20 amino acids outside of the PSMGFR sequence at the N-terminal end. 45C11 does not bind to the N-10 peptide. Normal tissue array FDA 1021 was stained with 45C11 at 12.5 ug/mL (FIG. 179-180). As can be seen in the figures, 45C11 shows strong binding to many normal tissues, including brain, heart, lung, liver, spleen, skeletal muscle and bone marrow. 45C11 was used over a range of concentrations to stain a breast cancer tissue array (FIG. 181-182). 45C11 was also used to stain a pancreatic cancer tissue array (FIG. 183-184). Taken together, these figures show that 45C11 has no cancer specificity.

Antibody 3C5 is an N+9/C-9 antibody that binds to epitope GTINVHDVET (SEQ ID NO: 1746). Like the other antibodies that bind to this epitope such as 32C1, 29H1 and 31A1, they bind to the most distal, that is to say the most N-terminal, part of the PSMGFR sequence. Unlike antibodies MNC2, MNE6 or 20A10, none of 3C5, 32C1, 31A1 or 29H1 can bind to the N-10 peptide but all do bind to the C-10 peptide. Examination of the entire normal tissue micro array, where 3C5 was used at 10 ug/mL, and the magnified images (FIG. 185-186) shows that antibody 3C5 strongly stains some normal tissues, including brain, heart, adrenal gland and bone marrow. 3C5 was also used to probe a pancreatic cancer array at 10 ug/mL, (FIG. 187-188). Taken together, these figures show that 3C5 has no cancer specificity.

Antibody 8A9 is an N+9/C-9 antibody that binds to epitope VOLTLAFRE (SEQ ID NO: 1750) which is outside of the PSMGFR sequence. Antibody 8A9 cannot bind to the N-10 peptide. Normal tissue array FDA 1021 was stained with 8A9 (FIG. 189-190). As can be seen in the figures, like antibody 45C11, which also binds an epitope that is N-terminal beyond the PSMGFR sequence, antibody 8A9 shows strong binding to many normal tissues, including adrenal, brain, heart, lung, liver, spleen, skeletal muscle and bone marrow. A pancreatic cancer array stained with antibody 8A9 showed weak binding to a subset of pancreatic cancer tissues (FIG. 191-192). Taken together, these figures show that 8A9 has no cancer specificity.

Antibody 17H6 is an N+9/C-9 antibody that binds to epitope VQLTLAFRE (SEQ ID NO: 1750), which is outside of the PSMGFR sequence. 17H6 was used to stain normal tissue array 1021. Examination of the entire normal tissue micro array and the magnified images (FIG. 193-194) shows that antibody 17H6 stains some normal tissues, including brain, heart, adrenal gland, bone marrow and skeletal muscle. 17H6 was used to probe a pancreatic cancer array and showed weak binding to most pancreatic cancer tissues (FIG. 195-196). However, the binding of 17H6 to several normal tissues of critical organs shows that 17H6 has little cancer specificity.

Antibody 39H5 is an N+9/C-9 antibody that binds weakly to the intact PSMGFR peptide but not significantly to any of the subset peptides. 39H5 may bind to the GTINVHDVET (SEQ ID NO: 1746), which is the most distal part of the PSMGFR sequence. Examination of the entire normal tissue micro array and the magnified images (FIG. 197-198) shows that antibody 39H5 stains some normal tissues, including brain, heart, liver and bone marrow. 39H5 was used to probe a pancreatic cancer array, (FIG. 199-200). Although 39H5 stained a good percentage of the pancreatic cancer specimens, considering the normal tissues that 39H5 stained, 39H5 has little cancer specificity.

Summary of FACS Analysis

Determining the cancer specificity of antibodies using cell lines is difficult, as these cells were obtained from a single patient's tumor decades ago, and then propagated in culture for decades. Even if the patient's tumor was at one point heterogeneous, the decades of in vitro culture have essentially made the cell line a single cell clone. Antibodies of the invention were assayed by FACS to determine if they bound to MUC1 or MUC1* positive cancer cells but not MUC1 negative cells. The results of these experiments are shown in FIGS. 76-87. What is very clear is that antibodies that bind to epitopes of the MUC1 sequence that are outside of and N-terminal to PSMGFR sequence show no cancer specificity. Referring now to the readings of Mean Fluorescence Intensity (MFI) it appears that antibodies with cognate epitopes at the very N-terminus of the PSMGFR sequence, such as those that bind to an epitope within GTINVHDVET (SEQ ID NO: 1746), show far less cancer specificity than the antibodies that recognize more C-terminal epitopes. For example, antibody MNC2 that will not bind to the C-10 peptide binds strongly to nearly every MUC1* positive cell line (FIG. 76-77). However, closer examination reveals that MNC2 binds lung cancer line NCI-H1975 much more strongly than NCI-H292. Similarly, MNC2 binds pancreatic cell line HPAF-II much better than Capan-1 or prostate cancer line DU145. PCR measurements show that the expression levels of cleavage enzymes varies greatly across a panel of cancer cell lines (FIG. 43 and FIG. 44). The fold of the MUC1* extra cellular domain can vary greatly depending on which cleavage enzyme clips it, which likely accounts for differences between cancer cell lines that a single antibody recognizes. This variation in antibody recognition of various cell lines, even within a cancer sub-type is apparent in the figures.

Summary of IHC Data

IHC analysis of real tissues, including both normal and cancerous tissues, is more informative than the study of cultured cell lines, as is necessary in FACS analysis. Each antibody was first tested over a range of concentrations to determine optimal concentration. Antibody concentration was increased until the stroma also picked up stain, which indicates non-specific background binding. The optimal concentration for that particular antibody was then deemed to be just below the concentration at which the antibody stained the stroma.

An overview of the IHC tissue studies is shown in FIG. 88-112. Here, we focused on the binding of antibodies to critical organ tissues, since binding to certain normal tissues would likely eliminate therapeutic use of that antibody. In these figures, the antibodies were grouped according to their

100 to epitopes that are N-terminal to the PSMGFR peptide such as epitope within SNIKFRPGSVV (SEQ ID NO: 1744) or VQLTLAFRE (SEQ ID NO: 1750) show such strong binding to normal heart that they could not be used in therapeutics. In addition, antibodies that bind to the more N-terminal portion of PSMGFR, such as 29H1, also show binding to normal heart. The antibodies with the least binding to normal tissues and the strongest binding to cancerous tissues bind to epitopes within the FPFS (SEQ ID NO: 1747) or PFPFSAQSGA (SEQ ID NO: 1743). Some antibodies that bind to epitopes within the ASRYNLT (SEQ ID NO: 1745) portion may also be suitable as therapeutics. These antibodies and others that recognize the same epitopes are desirable as anti-cancer therapeutics because they have a large therapeutic window, meaning that because of the low binding to normal tissues, and low side effects, patients can be dosed with antibody levels high enough to effectively kill the tumor cells. More detailed photographs of antibodies of the invention binding, or not binding, to other critical tissues are also shown. FIGS. 89-94 show magnified photographs of each antibody binding to normal heart tissue, where the antibodies have been categorized according to which epitope they bind. FIGS. 95-100 show magnified photographs of each antibody binding to normal liver tissue, where the antibodies have been categorized according to which epitope they bind. FIGS. 101-106 show magnified photographs of each antibody binding to normal lung tissue, where the antibodies have been categorized according to which epitope they bind. FIGS. 107-112 show magnified photographs of each antibody binding to normal bone marrow, where the antibodies have been categorized according to which epitope they bind.

The results of the IHC studies (FIG. 88-FIG. 200) are summarized in Table 3.

TABLE 3

| Antibody Name | HEART | BRAIN | LUNG | LIVER | SPLEEN | BONE MARROW | KIDNEY | SKELETAL MUSCLE | ADRENAL |
|---|---|---|---|---|---|---|---|---|---|
| PSMGFR | | | | | | | | | |
| MNC2 | | | | | | | | | |
| MNE6 | | | | | | | | | |
| 20A10 | | | | | | | | | |
| 25E6 | ~+ | | | | | | | ~+ | |
| 18B4 | | | +++ | | | + | | | |
| 18G12 | ++ | | | | | | +++ | +++ | |
| 28F9 | | | | | | | | ~+ | |
| 3C2B1 | | | | | | | | | |
| 5C6F3 | | | + | | | ~+ | ++ | | ++++ |
| N+20/ C-27 | | | | | | | | | |
| 1E4 | ++ | ++ | | +++ | | ~+ | | +++ | |
| 31A1 | ++ | +++ | ++ | | ++++ | ++++ | | + | |
| 32C1 | +++ | +++ | +++ | ++ | +++ | ++++ | | | ++ |
| 29H1 | + | ++++ | ++++ | ++++ | ++ | | | | ++++ |
| 45C11 | +++++ | ++++ | ++ | +++++ | ++ | +++ | + | +++++ | + |
| N+9/ C-9 | | | | | | | | | |
| 8A9 | +++++ | +++++ | +++ | +++++ | ++++ | ++++ | + | ++++ | +++ |
| 17H6 | +++ | ++++ | | | | + | | | ++ |
| 3C5 | +++ | ++++ | | + | | ++++ | | | +++ |
| 39H5 | ++++ | +++++ | + | +++ | +++ | ++++ | | | ++++ | cognate epitope. What is evident from the tissue studies is that the further the epitope is from the cell membrane, the more it binds to normal MUC1 on normal tissues. For example, binding to normal heart tissue by representative antibodies that recognize a specific epitope are shown in FIG. 88A-88L. As the figure illustrates, antibodies that bind As can be clearly seen in the table, the further away from the cell membrane that the antibody binds, the more non-specific binding there is. Although these antibodies were generated by immunizing with the PSMGFR peptide, N+20/C-27 peptide or the C+9/C-9 peptide, some of the antibodies generated by immunizing with an extended peptide still bind within the PSMGFR sequence, see FIGS. 63-69 for the details of epitope binding for each antibody. Some binding to normal tissues can be tolerated if the antibody is incorporated into an appropriate therapeutic format. For example, cellular therapies, such as CAR T, are carried by the blood and meet with physiological barriers including lamina propia and blood-brain barrier that limits the cell's access to luminal edge of ducts and glands. Other antibodies that bind much more strongly to cancerous tissues but do show some binding to normal tissues could also be safe and useful therapeutics if administered locally or if cancer-specificity is enhanced by incorporating into a bi-specific antibody. However, widespread antibody binding to many normal organs or to essential organs for which there is no physical barrier could be lethal to the patient.

The most cancer-specific antibodies with little to no binding to normal tissues are MNC2, MNE6, 20A10, 3C2B1 and 25E6. An ideal antibody therapeutic is one that stains no normal tissues but robustly stains cancer cells. Unfortunately, cancer antigens are also expressed on normal tissues, so zero staining of normal tissue is not possible. The aim is to identify an antibody that binds much more strongly to tumor tissue than normal tissue and that either binds to non-critical normal tissues or binds to them in a way that would not be physiologically possible in an intact organ. For example, CAR T cells are carried by the blood and the lamina propia is a barrier to their getting to the luminal edge of a duct or gland. Similarly, the blood brain barrier prevents the passage of large molecules like antibodies from the blood into the brain. The usefulness of an antibody as a therapeutic also depends on the format of the therapeutic. As mentioned, cell based therapies have natural barriers that prevent the CAR T cells from getting to some normal tissues. Antibody Drug Conjugate (ADC) based therapies sometimes depend on a local, cancer-specific molecule to activate the toxin attached to the antibody, minimizing the importance of whether or not a naked antibody binds to some normal tissue. In another example, antibodies and antibody-based therapeutics can be administered locally, including intraperitoneally, to maximize the effect on tumor cells while minimizing their effect on normal tissues. In yet another example, an antibody that is not purely cancer-specific can be made more cancer-specific if it is incorporated into a bi-specific antibody where a first side of the molecule binds to a first cancer antigen and the second side of the molecule binds to a second antigen that may be a tissue specific antigen, another cancer specific antigen or even an antigen on a cell such as a T cell, which are called BiTES, bispecific T cell engagers. In yet another example, the less cancer-specific antibody can be incorporated into a cell-based therapy where its expression is induced only after the cell recognizes a tumor. In one aspect, a CAR T cell can express a first CAR that recognizes a first antigen which recognition induces expression of a second antibody, or CAR incorporating the second antibody. In one aspect the cell expresses a CAR directed by an antibody fragment that is cancer-specific and a second antibody or CAR expressing the second antibody is induced to be expressed in an NFAT inducible system. In one aspect the nucleic acids encoding the second antibody or second CAR are down stream of NFAT response elements. The NFAT inducible gene may be inserted into a Foxp3 enhancer or promoter.

FIG. 202 shows photographs of pancreatic cancer tissues, each from a different patient. As can be seen, the staining pattern of 1E4 is very different from that of 18B4 and the polyclonal antibody SDIX. 18B4 and SDIX antibodies were generated by immunizing animals with the same peptide (PSMGFR), while the 1E4 antibody was generated from immunization with a different peptide (N+20). FIGS. 203-207 show magnified images of selected tissues from this array to highlight the differences between these antibodies. FIG. 208 compares the staining of polyclonal antibody SDIX to monoclonal antibody 20A10, which were both generated from immunization with the PSMGFR peptide. Also shown is the difference in staining pattern for antibody 29H1 which was generated by immunization with an N+20 peptide. Although the antibody staining is lighter, antibody 29H1 recognizes more pancreatic cancer tissue specimens than the SDIX polyclonal or 20A10. FIG. 209 shows that esophageal cancers are better recognized by antibodies that bind to a MUC1* peptide with an extended N-terminus, such as antibody 29H1 and antibody 31A1. Similarly, FIG. 210 shows that prostate cancers are better recognized by antibodies that bind to a MUC1* peptide with an extended N-terminus, such as antibody 29H1.

Below Table 4 shows a summary of the test criteria to determine the cancer-specificity of the various monoclonal antibodies.

TABLE 4

| Cancer-Specificity Test Criteria | | | | | | | |
|---|---|---|---|---|---|---|---|
| mAb Name | 1 Binds PSMGFR | 2 Does not bind N-10 | 3 Does not bind C-10 | 4 Displaces NME7$_{AB}$ from MUC1* | 5 Does not recognize linear epitope | 6 Recognizes MUC1 after cleavage by MMP9 | 7 Cancer selective by FACS | Cancer selective by IHC |
| FPFS (SEQ ID NO: 1747) | | | | | | | | |
| MNC2 | ☑ | ☑ | ☑ | ☑ | ☑ | ☑ | ☑ | ☑☑☑ |
| MNE6 | ☑ | ☑ | ☑ | ☑ | ☑ | ☑ | ☑ | ☑☑☑ |
| 20A10 | ☑ | ☑ | ☑ | ☑ | ☑ | ☑ | ☑ | ☑☑☑ |
| 3C2B1 | ☑ | ☑ | ☑ | ☑ | ☑ | ☑ | ☑ | ☑☑☑ |
| SVSDV (SEQ ID NO: 1751) | | | | | | | | |
| 5C6F3 | ☑ | ☑ | ~☑ | ☑ | ☑ | ☑ | ☑ | ☑☑ |

Above the FPFS/SEQ ID NO: 1747 row (spanning the criteria columns): ...VQLLAPRNXTINVHDVETQFNQYKTEAASRYNLTISDVSVSDVFPFSAQSGA TABLE 4-continued Cancer-Specificity Test Criteria

| mAb Name | Binds PSMGFR | 1 Binds N-10 | 2 Does not bind C-10 | 3 Displaces NME7$_{AB}$ from MUC1* | 4 Does not recognize linear epitope | 5 Recognizes MUC1 after cleavage by MMP9 | 6 Cancer selective by FACS | 7 Cancer selective by IHC |
|---|---|---|---|---|---|---|---|---|
| ASRYNLT (SEQ ID NO: 1745) | | | | | | | | |
| 25E6 | ☑ | ☑ | ☒ | ☑ | ☒ | ☑ | ☑ | ☑☑ |
| MNC3 | ☑ | ~√ | ☒ | ☒ | ☑ | ☒ | ND | ☑ |
| 18G12 | ☑ | ☑ | ☒ | ☑ | ☑ | ☒ | ~√ | ☑ |
| 28F9 | ☑ | ☑ | ☒ | ☑ | ☑ | ☒ | ~√ | ☑ |
| QFNQYKTEA (SEQ ID NO: 1749) | | | | | | | | |
| 1E4 | ☑ | ☑ | ☒ | ☑ | ☒ | ☑ | ~√ | ☑ |
| GTINVHDVET (SEQ ID NO: 1746) | | | | | | | | |
| 18B4 | ☑ | ☒ | ☒ | ~√ | ☒ | ☑ | ☑ | ☑ |
| 29H1 | ☑ | ☒ | ☒ | ~√ | ☒ | ☑ | ☒ | ☒ |
| 31A1 | ☑ | ☒ | ☒ | ☑ | ☒ | ☑ | ☒ | ☒ |
| 32C1 | ☑ | ☒ | ☒ | ~√ | ☒ | ☑ | ☒ | ☒ |
| 39H5 | ☑ | ☒ | ☑ | ~√ | ☒ | ☒ | ☒ | ☒ |
| 3C5 | ☑ | ☒ | ☑ | ☒ | ☒ | ☒ | ☒ | ☒☒ |
| VQLTLAFRE (SEQ ID NO: 1750) | | | | | | | | |
| 8A9 | ☒ | ☒ | ☑ | ☒ | ☒ | ☒ | ☒ | ☒☒ |
| 17H6 | ☒ | ☒ | ☑ | ☒ | ☒ | ☒ | ☒ | ☒ |
| SNIKFRPGSVV (SEQ ID NO: 1744) | | | | | | | | |
| 45C11 | ☒ | ☒ | ☑ | ☒ | ☑ | ☒ | ☒ | ☒☒☒ |

To summarize, we found that antibodies that bound to sequences that are N-terminal to the PSMGFR sequence had no cancer-specificity. Further, the closer to the cell membrane that the antibody binds, the more cancer-specific is the antibody. More importantly, test criteria 1-4 or even 1-5 provide a set of rapid, multiplexed and inexpensive tests that can be performed on hundreds or thousands of impure hybridoma clone supernatants to identify antibodies that are highly selective for cancer-specific forms of MUC1*.

Satisfies Test Criteria

In a preferred embodiment an antibody is chosen for the treatment, prevention or diagnosis of cancer based on satisfying four (4) of the seven (7) criteria set out in Table 4. In a more preferred embodiment an antibody is chosen for the treatment, prevention or diagnosis of cancer based on satisfying five (5) of the seven (7) criteria set out in Table 4. In a yet more preferred embodiment an antibody is chosen for the treatment, prevention or diagnosis of cancer based on satisfying six (6) of the seven (7) criteria set out in Table 4. In a more preferred embodiment an antibody is chosen for the treatment, prevention or diagnosis of cancer based on satisfying all seven (7) of the criteria set out in Table 4.

Bind to N-10

We have demonstrated that a MUC1 transmembrane protein, devoid of tandem repeats and having an extra cellular domain of 45 amino acids of PSMGFR sequence, is sufficient to function as a growth factor receptor and confers oncogenic characteristics to the cell (Mahanta et al 2008). Antibodies that bind to the PSMGFR peptide or portion of a transmembrane MUC1 cleavage product can be cancer specific but may also bind to stem or progenitor cells. Antibodies that bind to the N-10 peptide are more cancer-specific. In a preferred embodiment an antibody is chosen for the treatment, prevention or diagnosis of cancer based on the ability of the antibody to bind to the N-10 peptide.

do not Bind to C-10

We have demonstrated that the MUC1 extra cellular domain contains an ectopic binding site that is only exposed if the tandem repeat domain is missing, which can occur as a consequence of alternative splice variant or cleavage and release of the extra cellular domain. Cancer-specific antibodies MNC2 and MNE6 will not bind to full-length MUC1, but do bind to the remaining portion when MUC1 is cleaved and the tandem repeat domain is shed. MNC2 and MNE6 will bind to a MUC1*-like protein if it is devoid of tandem repeats, for example if a MUC1 negative cell is transfected or transduced with an engineered MUC1 that is devoid of tandem repeats, especially if extra cellular domain comprises the PSMGFR. Thus, the ectopic site to which MNC2 and MNE6 bind is unmasked when tandem repeat domain is missing or removed. Both MNC2 and MNE6 require the 10 membrane proximal amino acids of a MUC1* extra cellular domain for binding; they do not bind to the C-10 peptide. That means that the ectopic binding site for MNC2 and MNE6 is within or contains all or part of the 10 C-terminal amino acids of the PSMGFR: PFPFSAQSGA (SEQ ID NO: 1743). In a preferred embodiment an antibody is chosen for the treatment, prevention or diagnosis of cancer based on the inability of the antibody to bind to the C-10 peptide. In a preferred embodiment an antibody is chosen for the treatment, prevention or diagnosis of cancer based on the ability of the antibody to bind to the N-10 peptide and the inability of the antibody to bind to the C-10 peptide.

Compete with $NME7_{AB}$ or NME7-X1 for Binding to MUC1* Positive Cell, PSMGFR Peptide or N-10 Peptide We have demonstrated that cancer-specific antibodies MNC2 and MNE6 bind to an ectopic epitope that comprises all or part of the 10 C-terminal amino acids of the PSMGFR peptide: PFPFSAQSGA (SEQ ID NO: 1743). We have shown that growth factors, dimeric NME1 and $NME7_{AB}$, also bind to an ectopic epitope that comprises all or part of the 10 C-terminal amino acids of the PSMGFR peptide. MNC2 and MNE6 compete with dimeric NME1 or $NME7_{AB}$ for binding to the PSMGFR peptide and the N-10 peptide. In a preferred embodiment an antibody is chosen for the treatment, prevention or diagnosis of cancer based on the ability of the antibody to disrupt the binding of NME1, $NME7_{AB}$, or NME7-X1 to the PSMGFR peptide, the N-10 peptide, or to the surface of a MUC1* positive cancer cell.

Recognize a Conformational Epitope Rather than a Linear Epitope

Antibodies that are cancer-specific will be chosen based on their ability to bind to a MUC1 that is devoid of tandem repeats and for their inability to bind to full-length MUC1. Most often, MUC1* is generated when MUC1 is cleaved by a cleavage enzyme and the tandem repeat domain is released from the cell surface. Cleavage and release of the tandem repeat domain may also unmask portions of MUC1*-like cleavage products that exist on normal tissues. However, antibodies that recognize a conformation, rather than a linear epitope, are more selective. Antibodies that recognize a conformational epitope rather than a linear epitope can be identified by a variety of means. In particular, antibodies that recognize a conformational epitope will not work in a denaturing Western blot assay. In a preferred embodiment an antibody is chosen for the treatment, prevention or diagnosis of cancer based on the ability of the antibody to recognize a conformational epitope.

Recognize a MUC1* Generated by Cleavage by MMP9 or Other Tumor-Associated Cleavage Enzyme The fold, or conformation, of the MUC1* truncated extra cellular domain differs depending on which enzyme cleaves MUC1. Cleaved MUC1* or MUC1*-like cleavage products can function as growth factor receptors on normal healthy tissues. More than one cleavage enzyme is able to cleave MUC1 to a MUC1*-like form. Cleavage by first enzyme may produce a conformation or a fold that is not the same as that produced by cleavage by a second enzyme. Support for this can be found in this application and is illustrated in FIGS. 39-41. These figures show that although a polyclonal antibody that binds to PSMGFR recognizes a cleaved MUC1 on hematopoietic stem cells, some monoclonal antibodies that bind to the PSMGFR peptide can bind to this MUC1*-like form on hematopoietic stem cells while others cannot. For example, MNC3 readily recognizes this cleaved form of MUC1 on hematopoietic stem cells, but MNC2 and MNE6 do not. We know that MNC2 and MNE6 recognize a MUC1* that is produced by cleavage by MMP9 but not when it is cleaved by MMP2. MNC2 and MNE6 are cancer-specific while MNC3 is not, as it recognizes stem and progenitor cells. We also know that MMP9 is overexpressed in cancers. Bone marrow, where hematopoietic stem cells are made expresses nearly 2,500-times more MMP2 than MMP9 (FIG. 65). MMP14 is another enzyme that cleaves MUC1 to a MUC1* growth factor receptor form (FIG. 38). In one aspect of the invention, an antibody is chosen for the treatment, prevention or diagnosis of cancer based on the ability of the antibody to recognize a MUC1 cleavage product generated when MUC1 is cleaved by MMP14. In a preferred embodiment an antibody is chosen for the treatment, prevention or diagnosis of cancer based on the ability of the antibody to recognize a MUC1 cleavage product generated when MUC1 is cleaved by MMP9. In a preferred embodiment an antibody is chosen for the treatment, prevention or diagnosis of cancer based on the ability of the antibody to recognize a MUC1 cleavage product generated when MUC1 is cleaved by MMP9 and also recognizes a conformational epitope.

Binds to Cancer Cells More than Normal Cells

A traditional approach to identifying antibodies that are cancer-specific involves testing a panel of antibodies against a panel of different cancer cell lines and determining, by FACS, IF, immunoprecipitation or other method, if the antibody binds to cancer cells. Although this approach is traditional, it is sequential and time-consuming, and thus limits the analysis of large numbers of monoclonal antibody clones, which is required to find an ideal antibody suitable for cancer therapeutic or diagnostic. In addition, there are no real normal cell lines and the selection of normal primary cells is limited. The selection criteria presented above provide a rapid, multiplexed method for identifying monoclonal antibody clones that are specific for MUC1* positive cancers. For many of the selection criteria, hybridoma supernatants can be used. This provides a huge advantage over state of the art methods for identifying antibodies that are specific for MUC1* positive cancers. The ability to select antibodies from assay performed using the impure hybridoma supernatants means that much of the selection can be done on hundreds or thousands of clones rapidly and at very little cost. Methods such as FACS analysis ans IHC tissue studies require the use of purified antibodies which limits the number of clones that can be tested to tens, not even hundreds.

However, selecting an antibody based on its ability to bind to cancer cells, or a cancer cell type or to a cell engineered to express a certain antigen is important for antibody selection. In a preferred embodiment an antibody is chosen for the treatment, prevention or diagnosis of cancer based on the ability of the antibody to bind to MUC1* positive cancer cells.

Binds to Tumor Tissue More than Normal Tissue

Immunohistochemistry, IHC, tissue studies of cancerous versus normal tissues is a more stringent test of the cancer specificity of antibodies than FACS analysis. Cancer cell lines are a single cell from a single patient that have been expanded in a lab for decades and are not representative of a cross section of the human population. Further, analysis of cell lines is blind to the heterogeneity of actual tumors. Tissue studies require purified antibody, are very expensive, time-consuming and require a skilled pathologist to analyze each stained tissue specimen. However, antibody staining of tissues from normal tissues versus cancerous tissues can reveal which antibodies cannot be used as therapeutics or diagnostics because of their cross-reactivity with normal tissues. Our systematic studies of numerous antibodies with thousands of human normal tissues or cancerous tissues, across several cancer sub-types showed that antibodies that bind to N-10, not C-10, disrupt the binding of NME1 or NME7$_{AB}$, or NME7-X1 to the PSMGFR peptide, the N-10 peptide, or to the surface of a MUC1* positive cancer cell, recognize a conformational epitope, and recognize a conformational epitope created by cleavage by MMP9 are the most cancer-specific.

In a preferred embodiment an antibody is chosen for the treatment, prevention or diagnosis of cancer based on the ability of the antibody to bind to MUC1* positive tumor tissue at least 2-times more than it binds to normal tissues. In a preferred embodiment an antibody is chosen for the treatment, prevention or diagnosis of cancer based on the ability of the antibody to bind to MUC1* positive tumor tissue at least 5-times more than it binds to normal tissues. In a preferred embodiment an antibody is chosen for the treatment, prevention or diagnosis of cancer based on the ability of the antibody to bind to MUC1* positive tumor tissue at least 10-times more than it binds to normal tissues.

Antibodies that Bind to Refined Epitopes

In a preferred embodiment, an antibody, or fragments thereof, that binds to a peptide comprising the sequence QFNQYKTEAASRYNLTISDVSVSDVPFPFSAQSGA (SEQ ID NO: 3) are incorporated into anti-cancer therapeutics or diagnostics.

In a more preferred embodiment, an antibody, or fragments thereof, that binds to a peptide comprising the sequence ASRYNLTISDVSVSDVPFPFSAQSGA (SEQ ID NO: 4) are incorporated into anti-cancer therapeutics or diagnostics.

In a yet more preferred embodiment, an antibody, or fragments thereof, that binds to a peptide comprising the sequence SDVSVSDVPFPFSAQSGA (SEQ ID NO: 1802) are incorporated into anti-cancer therapeutics or diagnostics.

In a still more preferred embodiment, an antibody, or fragments thereof, that binds to a peptide comprising the sequence SVSDV (SEQ ID NO: 1751) are incorporated into anti-cancer therapeutics or diagnostics.

In a yet still more preferred embodiment, an antibody, or fragments thereof, that binds to a peptide comprising some or all of the sequence PFPFSAQSGA (SEQ ID NO: 1743) are incorporated into anti-cancer therapeutics or diagnostics.

Consensus Sequences

Antibodies of the invention were categorized according to cognate epitope. Sequences of their respective heavy chain CDRs are shown in Table 5. Sequences of their respective light chain CDRs are shown in Table 6. Consensus sequences for CDR1, CDR2 and CDR3 for each epitope-specific set of antibodies were computer generated. FIG. 215 and FIG. 216 show how the CDR consensus sequences change as the position of the antibodies' cognate epitope moves from the membrane-proximal portion of PSMGFR toward the more distal portions.

As can be seen in Table 5 and Table 6, the sequences for CDR1 and CDR2 for antibodies that bind to epitopes within the 10 membrane-proximal (C-terminal) portion of PSMGFR peptide closely adhere to the consensus sequence.

TABLE 5

| HEAVY CHAIN CDRs | | | | |
|---|---|---|---|---|
| Epitope SEQ ID NO | Name | CDR1 SEQ ID NO | CDR2 SEQ ID NO | CDR3 SEQ ID NO |
| FPFS 1747 | MNC2 | FTFSGYAMS 1794 | TISSGGTYIYYPDSVKG 127 | -LGGDNYYEYFDV-- 127 |
| FPFS 1747 | MNE6 | FTFSRYGMS 1795 | TISGGGTYIYYPDSVKG 21 | DNYGRNYDYGMDY-- 25 |
| FPES 1747 | 20A10 | FTFSTYAMS 1797 | -SIGRAGSTYYSDSVKG 997 | ---GPIYNDYDEFAY 1001 |
| FPFS 1747 | 3C2B1 | ITFSTYTMS 1798 | TISTGGDKTYYSDSVKG 1393 | -GTTAMYYYAMDY- 1397 |
| Consensus Sequence | | FTFSxYAMS | TISxGGxYxYYPDSVKG | xxxGxNYDYxxDx |
| SVSDV 1751 | 5C6F3 | FTFSTYAMS 1797 | AISNGGGYTYYPDSLKG 1363 | RYYDHYFDY 1367 |
| ASRYNLT 1745 | 25E6 | FTFSSYGMS 1799 | TISNGGRHTFYPDSVKG 1029 | QTGTEGWFAY 1033 |
| ASRYNLT 1745 | MNC3 | YRFTDYAMN 1804 | VISTFSGNTNFNQKFKG 422 | SDYYGPYFDY 426 |
| ASRYNLT 1745 | 18G12 | YTFTGYFLY 1805 | GINPDNGGIDFNEKFRN 965 | --LIGNY--- 969 |
| ASRYNLT 1745 | 28F9 | YTFTGYFLY 1805 | GIHPSNGDTDFNEKFKN 1061 | --LIGVY--- 1065 |
| Consensus Sequence | | xxFxxYxx | xIxxxxxxxFxxxxxx | xxxxxxFxY |
| QFNQYKTEA 1749 | 1E4 | YAFSTYWMN 1806 | QIYPGDSDTNYNGKFKG 1205 | GNHASMDY 1209 |

TABLE 5-continued

| HEAVY CHAIN CDRs | | | | |
| --- | --- | --- | --- | --- |
| Epitope SEQ ID NO | Name | CDR1 SEQ ID NO | CDR2 SEQ ID NO | CDR3 SEQ ID NO |
| GTINVHDVET 1746 | 18B4 | FTFNDAWMD 1807 | EIRSTANIHTTYYAESVQG 1093 | -----LLYGFAY 1097 |
| GTINVHDVET 1746 | 29H1 | FTFSDAWMD 1808 | EIRSKATNHATYYAESVKG 1237 | -----LLYGFAY 1097 |
| GTINVHDVET 1746 | 31A1 | YTFTSYWMH 1809 | --YINPSTGYTEYNQKFKD 1269 | -----AYIDY- 1273 |
| GTINVHDVET 1746 | 32C1 | FTFSNYWMN 1810 | EIRLKSNNYAIHYAESVKG 1301 | VPGLDAY----- 1305 |
| GTINVHDVET 1746 | 39H5 | YTFTNYGMN 1811 | --WINTYTGEPTYVGDFKG 869 | --GIHGYVDY- 873 |
| GTINVHDVET 1746 | 3C5 | YTFTNYGMN 1811 | --WINTYTGKPTYADDFKG 901 | -GGLDGYYGY- 905 |
| Consensus Sequence | | ˑTFˑˑˑWˑˑ | EˑˑˑˑˑˑˑˑˑˑˑˑˑKG | VˑˑLˑˑˑˑˑAY |

TABLE 6

| LIGHT CHAIN CDRs | | | | |
| --- | --- | --- | --- | --- |
| Epitope SEQ ID NO | Name | CDR1 SEQ ID NO | CDR2 SEQ ID NO | CDR3 SEQ ID NO |
| FPFS 1747 | MNC2 | RASKS--VSTSGYSYMH 173 | LASNLES 177 | QHSRELPFT 181 |
| FPFS 1747 | MNE6 | -------SATSSVSYIH 70 | STSNLAS 74 | QQRSSSPFT 78 |
| FPFS 1747 | 20A10 | KSSQSVLYSSNOKNYLA 1009 | WASTRES 1013 | -HQYLSSLT 1017 |
| FPFS 1747 | 3C2B1 | RASKS---ISTSDYNYIH 1403 | LASNLES 177 | QHSRELPLT 1411 |
| Consensus Sequence | | RASKˑˑˑSTSˑˑNˑˑˑ | LASNLES | QHˑˑˑLPFT |
| SVSDV 1751 | 5C6F3 | RSSQTIVHSNGNTYLE 463 | KVSNRFS 467 | FQDSHVPLT 1381 |
| ASRYNLT 1745 | 25E6 | KSSQSLLDSDGKTYLN 1041 | LVSKLDS 981 | WQGTHFPQT 1049 |
| ASRYNLT 1745 | MNC3 | RSSQTIVHSNGNTYLE 463 | KVSNRFS 467 | FQGSHVPFT 471 |
| ASRYNLT 1745 | 18G12 | KSSQSLLHSDGKTYLI 977 | LVSKLDS 981 | CQGTHFPWT 985 |
| ASRYNLT 1745 | 28F9 | KSSQSLLHSDGKTYLI 977 | LVSKLDS 981 | CQGTHFPWT 985 |
| Consensus Sequence | | KSSQˑLLˑˑDKTLˑ | LVSKLDS | ˑQGTHFPˑT |
| QFNQYKTEA 1749 | 1E4 | RSSQSLVHSNGNTYLH 1217 | KVSNRFS 467 | SQKTHVPWT 1225 |
| GTINVHDVET 1746 | 18B4 | RTSQSLVHSNGNTYLH 1105 | KVSSRFS 1109 | SQNTHVPYT 1113 |
| GTINVHDVET 1746 | 29H1 | RSGQSLVHSNGHTYLH 1249 | KVSNRFS 467 | SQTTHVPWT 1257 |
| GTINVHDVET 1746 | 31A1 | RSSQSIVHSNGNTYLE 1812 | KVSNRFS 467 | FQVSHFPWT 1289 |

TABLE 6-continued

| LIGHT CHAIN CDRs | | | | |
| --- | --- | --- | --- | --- |
| Epitope SEQ ID NO | Name | CDR1 SEQ ID NO | CDR2 SEQ ID NO | CDR3 SEQ ID NO |
| GTINVHDVET 1746 | 32C1 | RSSQSLVHSNGNTYLH 1217 | KVSNRFS 467 | SQITHVPYT 1321 |
| GTINVHDVET 1746 | 39H5 | RSSQSIVHRNGNTYL- 1813 | KVSNRFS 467 | FQGSHLPWT 889 |
| GTINVHDVET 1746 | 3C5 | KSSQSLLHSKGKTYLN 913 | LVSKLES 917 | LQTTHEPWT 921 |
| Consensus Sequence | | RSSQSLVHSNGNTYLH | KVSNRFS | SQITHVPWT |

Whereas Heavy Chain CDR1 for MNC2 is FTFSGYAMS (SEQ ID NO: 1794), with the amino acids numbered from left to right 1 through 9, the consensus of other antibodies that bind to that portion of PSMGFR is: F or I at position 1, T at position 2, F at position 3, S at position 4, T, G, or R at position 5, Y at position 6, A, G or T at position 7, M at position 8 and S at position 9.

In a preferred embodiment an antibody is chosen for the treatment, prevention or diagnosis of cancer based on having a heavy chain CDR1 that is at least 90% identical to a CDR1 comprising the following amino acids at the specified positions: F or I at position 1, T at position 2, F at position 3, S at position 4, T, G, or R at position 5, Y at position 6, A, G or T at position 7, M at position 8 and S at position 9.

Whereas Heavy Chain CDR2 for MNC2 is TIS-SGGTYIYYPDSVKG (SEQ ID NO: 127), with the amino acids numbered from left to right 1 through 17, the consensus of other antibodies that bind to that portion of PSMGFR is: T at position 1, I or S at position 2, I or S at position 3, G or R at position 5, G or A at position 6, T or I at position 9, Y at position 10, Y at position 11, P or S at position 12 and DSVKG (SEQ ID NO: 1793) for positions 13-17.

In a preferred embodiment an antibody is chosen for the treatment, prevention or diagnosis of cancer based on having a heavy chain CDR2 that is at least 90% identical to a CDR2 comprising the following amino acids at the specified positions: T at position 1, I or S at position 2, I or S at position 3, G or R at position 5, G or A at position 6, T or I at position 9, Y at position 10, Y at position 11, P or S at position 12 and DSVKG (SEQ ID NO: 1793) for positions 13-17.

Whereas Heavy Chain CDR3 for MNC2 is-LGGDNYY-EYFDV--(SEQ ID NO: 131), with the amino acids numbered from left to right 1 through 15, the consensus of other antibodies that bind to that portion of PSMGFR is: G, L, or N at position 2, G or T at position 4, Y at position 7, D or E at position 12, A at position 14, and Y at position 15.

In a preferred embodiment an antibody is chosen for the treatment, prevention or diagnosis of cancer based on having a heavy chain CDR3 that is at least 90% identical to a CDR3 comprising the following amino acids at the specified positions: G, L, or N at position 2, G or T at position 4, Y at position 7, D or E at position 12, A at position 14, and Y at position 15.

Whereas Light Chain CDR1 for MNC2 is RASKS--VSTSGYSYMH (SEQ ID NO: 173), with the amino acids numbered from left to right 1 through 17, the consensus of other antibodies that bind to that portion of PSMGFR is: K or R at position 1, A or S at position 2, S at position 3, K or Q at position 4, S at position 5, V at position 6, L at position 7, T or S at position 10, Y at position 15, and I, L or M at position 16.

In a preferred embodiment an antibody is chosen for the treatment, prevention or diagnosis of cancer based on having a light chain CDR1 that is at least 90% identical to a CDR1 comprising the following amino acids at the specified positions: K or R at position 1, A or S at position 2, S at position 3, K or Q at position 4, S at position 5, L or V at position 6, L at position 7, T or S at position 10, Y at position 15, and I, L or M at position 16.

Whereas Light Chain CDR2 for MNC2 is LASNLES (SEQ ID NO: 177), with the amino acids numbered from left to right 1 through 7, the consensus of other antibodies that bind to that portion of PSMGFR is: L or W, or S at position 1, A or T at position 2, S at position 3, N or T at position 4, L or R at position 5, E or A at position 6, and S at position 7.

In a preferred embodiment an antibody is chosen for the treatment, prevention or diagnosis of cancer based on having a light chain CDR2 that is at least 90% identical to a CDR2 comprising the following amino acids at the specified positions: L or W, or S at position 1, A or T at position 2, S at position 3, N or T at position 4, L or R at position 5, E or A at position 6, and S at position 7.

Whereas Light Chain CDR3 for MNC2 is QHSRELPFT (SEQ ID NO: 181), with the amino acids numbered from left to right 1 through 9, the consensus of other antibodies that bind to that portion of PSMGFR is: Q at position 1, H or Q at position 2, S, Q or R at position 3, R, S or Y at position 4, E, L, or S at position 5, L or S at position 6, P or S at position 7, F or L at position 8 and T at position 9.

In a preferred embodiment an antibody is chosen for the treatment, prevention or diagnosis of cancer based on having a light chain CDR3 that is at least 90% identical to a CDR3 comprising the following amino acids at the specified positions: Q at position 1, H or Q at position 2, S, Q or R at position 3, R, S or Y at position 4, E, L, or S at position 5, L or S at position 6, P or S at position 7, F or L at position 8 and T at position 9.

Another set of antibodies was generated and resultant clones were tested for their ability to bind to PSMGFR, N-10 and C-10 peptides. Antibody clones that bound to PSMGFR and N-10 peptides, but not to the C-10 peptide were selected. These antibodies were sequenced. Table 7 shows the sequences of the heavy chain CDRs for cancer-specific antibodies MNC2, MNE6, 20A10, 3C2B1, plus new antibodies B2, B7, 8C7F3, H11 and B9. Table 8 shows the sequences of the light chain CDRs for cancer-specific antibodies MNC2, MNE6, 20A10, 3C2B1, plus new antibodies B2, B7, 8C7F3, H11 and B9. Consensus sequences for the heavy and light chain CRDs were generated and are shown in Table 7 and Table 8. Although antibodies 5C6F3 and 25E6 showed great cancer specificity in IHC tissue studies and they both bound to the PSMGFR and N-10 peptides, but not to the C-10 peptide, epitope mapping showed that they bound to epitopes that were a bit N-terminal to the epitopes to which MNC2, MNE6, 20A10 and 3C2B1 bound. For this reason, consensus sequences were generated for MNC2, MNE6, 20A10, 3C2B1 and the new antibodies plus consensus sequences were generated for all the antibodies that bound to N-10 but not to C-10.

As can be seen in Table 7 and Table 8, the sequences for CDR1, CDR2 and CDR3 for antibodies that require for binding the 10 membrane-proximal (C-terminal) amino acids of PSMGFR peptide closely adhere to a common consensus sequence.

TABLE 7

HEAVY CHAIN CDRs for antibodies that share broader epitope in that they cannot bind to the C-10 peptide

| Epitope SEQ ID NO | Name | CDR1 SEQ ID NO | CDR2 SEQ ID NO | CDR3 SEQ ID NO |
|---|---|---|---|---|
| FPFS 1747 | MNC2 | FTFSGYAMS 1794 | TISSGGTYIYYPDSVKG 127 | -LGGDNYYEYFDV-- 131 |
| FPFS 1747 | MNE6 | FTFSRYGMS 1795 | TISGGGTYIYYPDSVKG 21 | DNYGRNYDYGMDY-- 25 |
| FPFS 1747 | 20A10 | FTFSTYAMS 1797 | -SIGRAGSTYYSDSVKG 997 | ---GPIYNDYDEFAY 1001 |
| FPFS 1747 | 3C2B1 | ITFSTYTMS 1798 | TISTGGDKTYYSDSVKG 1393 | -GTTAMYYYAMDY-- 1397 |
| PFPFSAQSGA 1743 | B2 | FAFSTFAMS 1796 | AISNGGGYTYYPDTLKG 1439 | ----RYYDLYFDL-- 1443 |
| PFPFSAQSGA 1743 | B7 | FTFSRYGMS 1795 | TISSGGTYIYYPDSVKG 127 | DNYGSSYDYAMDY-- 1471 |
| PFPFSAQSGA 1743 | 8C7F3 | FTFSTYAMS 1797 | AISNGGGYTYYPDSLKG 1363 | ----RYYDHYFDY-- 1367 |
| PFPFSAQSGA 1743 | H11 | FAFSTFAMS 1796 | AISNGGGYTYYPDTLKG 1439 | ----RYYDLYFDL-- 1443 |
| PFPFSAQSGA 1743 | B9 | FTFSRYGMS 1795 | TISSGGTYIYYPDSVKG 127 | DNYGSSYDYAMDY-- 1471 |
| Consensus Sequence - all of antibodies above | | *(illegible)* | *(illegible)* | *(illegible)* |
| SVSDV 1751 | 5C6F3 | FTFSTYAMS 1797 | AISNGGGYTYYPDSLKG 1363 | RYYDHYFDY 1367 |
| ASRYNLT 1745 | 25E6 | FTFSSYGMS 1799 | TISNGGRHTFYPDSVKG 1029 | QTGTEGWFAY 1033 |
| Consensus Sequence - all antibodies | | *(illegible)* | *(illegible)* | *(illegible)* |

TABLE 8

LIGHT CHAIN CDRs for antibodies that share broader epitope in that they cannot bind to the C-10 peptide

| Epitope | Name | CDR1 | CDR2 | CDR3 |
|---|---|---|---|---|
| FPFS 1747 | MNC2 | RASKS--VSTSGYSYMH 173 | LASNLES 177 | QHSRELPFT 181 |
| FPFS 1747 | MNE6 | -------SATSSVSYIH 70 | STSNLAS 74 | QQRSSSPFT 78 |
| FPFS 1747 | 20A10 | KSSQSVLYSSNQKNYLA 1009 | WASTRES 1013 | -HQYLSSLT 1017 |

TABLE 8-continued

LIGHT CHAIN CDRs for antibodies that share broader epitope in that they
cannot bind to the C-10 peptide

| Epitope | Name | CDR1 | CDR2 | CDR3 |
|---|---|---|---|---|
| FPFS 1747 | 3C2B1 | RASKS---ISTSDYNYIH 1403 | LASNLES 177 | QHSRELPLT 1411 |
| PFPFSAQSGA 1743 | B2 | RSSQNIV-HSNGNTYLE 1449 | KVSNRFS 467 | FQDSHVPLT 1381 |
| PFPFSAQSGA 1743 | B7 | RSSQTIV-HSNGNTYLE 463 | KVSNRFS 467 | FQDSHVPLT 1381 |
| PFPFSAQSGA 1743 | 8C7F3 | --RASESVATYGNNFMQ 1431 | LASTLDS 1509 | QQNNEDPPT 1513 |
| PFPFSAQSGA 1743 | H11 | RSSQNIV-HSNGNTYLE 1449 | KVSNRFS 467 | FQDSHVPLT 1381 |
| PFPFSAQSGA 1743 | B9 | -------SASSSVSYMH 1561 | TTSNLAS 1565 | QQRSSYPF- 1569 |
| Consensus Sequence - all of antibodies above | | | | |
| SVSDV 1751 | 5C6F3 | RSSQTIVHSNGNTYLE | KVSNRFS 467 | FQDSHVPLT 1381 |
| ASRYNLT 1745 | 25E6 | KSSQSLLDSDGKTYLN | LVSKLDS | WQGTHFPQT |
| Consensus Sequence - all antibodies | | | | |

Whereas Heavy Chain CDR1 for MNC2 is FTFSGYAMS (SEQ ID NO: 1794), with the amino acids numbered from left to right 1 through 9, the consensus sequence of MNC2, MNE6, 20A10, 3C2B1 and new antibodies B2, B7, 8C7F3, H11 and B9 is: F or I at position 1, T or A at position 2, F at position 3, S at position 4, T, G, or R at position 5, Y or F at position 6, A, G or T at position 7, M at position 8 and S at position 9. The underlined amino acids at positions 2 and 6 are the only additional variants to the consensus sequence generated for cancer-specific antibodies MNC2, MNE6, 20A10, 3C2B1 alone.

As can be seen in Table 7, the inclusion of antibodies 5C6F3 and 25E6 into the generation of consensus sequence did not change in any way the consensus sequence for heavy chain CDR1 that describes a cancer-specific anti-MUC1* antibody.

In a preferred embodiment an antibody is chosen for the treatment, prevention or diagnosis of cancer based on having a heavy chain CDR1 that is at least 90% identical to a CDR1 comprising the following amino acids at the specified positions: F or I at position 1, T or A at position 2, F at position 3, S at position 4, T, G, or R at position 5, Y or F at position 6, A, G or T at position 7, M at position 8 and S at position 9.

Whereas Heavy Chain CDR2 for MNC2 is TIS-SGGTYIYYPDSVKG (SEQ ID NO: 127), with the amino acids numbered from left to right 1 through 17, the consensus sequence of MNC2, MNE6, 20A10, 3C2B1 and new antibodies B2, B7, 8C7F3, H11 and B9 is:

T or A at position 1, I or S at position 2, I or S at position 3, N, S, T or G at position 4, G or R at position 5, G or A at position 6, G, T, or D at position 7, Y, K or S at position 8, T or I at position 9, Y at position 10, Y at position 11, P or S at position 12 and D at position 13, S or T at position 14, V or L at position 15 and KG for positions 16-17. The underlined amino acids indicate how this more inclusive consensus sequence differs from the consensus sequence generated for MNC2, MNE6, 20A10 and 3C2B1 alone. Of the 17 amino acids in heavy chain CDR2, the consensus sequence for all nine antibodies differs from the consensus sequence for the original cancer-specific four by only 4 amino acids. Note that 2 of the 4 variants are homologous changes, T for S and L for V, which generally do not significantly impact the structure or specificity of a protein.

As can be seen in Table 7, the inclusion of antibodies 5C6F3 and 25E6 into the generation of consensus sequence for heavy chain CDR2 only changed the consensus sequence by the addition of two other possible amino acids: a possible H at position 8, and a possible F at position 10, for a heavy chain CDR2 that describes a cancer-specific anti-MUC1* antibody. We note that the change of Y to F at position 10 is a homologous change, which generally does not significantly impact the structure or specificity of a protein.

In a preferred embodiment an antibody is chosen for the treatment, prevention or diagnosis of cancer based on having a heavy chain CDR2 that is at least 90% identical to a CDR2 comprising the following amino acids at the specified positions: T or A at position 1, I or S at position 2, I or S at position 3, N, S, T or G at position 4, G or R at position 5, G or A at position 6, G, T, or D at position 7, Y, K, H or S at position 8, T or I at position 9, Y or F at position 10, Y at position 11, P or S at position 12 and D at position 13, S or T at position 14, V or L at position 15 and KG for positions 16-17.

Whereas Heavy Chain CDR3 for MNC2 is LGGDNYY-EYFDV (SEQ ID NO: 131), with the amino acids numbered from left to right 2 through 13, the consensus sequence of MNC2, MNE6, 20A10, 3C2B1 and new antibodies B2, B7, 8C7F3, H11 and B9 is:

G, L, or N at position 2, G, T, or Y at position 3, G or T at position 4, A, D, P, R, or S at position 5, Y, M, I or S at position 6, Y at position 7, D, Y, or N at position 8, E, D, Y, L or H at position 9, Y, A, or G at position 10, M, D or F at position 11, D or E at position 12, V, F, Y or L at position 13, and AY at position 14-15. The underlined amino acids indicate how this more inclusive consensus sequence differs from the consensus sequence generated for MNC2, MNE6, 20A10 and 3C2B1 alone. Of the 15 amino acids in heavy chain CDR3, the consensus sequence for all nine antibodies differs from the consensus sequence for the original cancer-specific four by 7 amino acids, with 3 of the 7 substitutions at position 6. For this reason, we conclude that the amino acid at position 6 can be varied without altering the specificity of the antibody.

Analysis of the consensus sequence generated with the inclusion of antibodies 5C6F3 and 25E6 highlighted which amino acids were conserved among all eleven antibodies. For this reason, our preferred consensus sequence for heavy chain CDR3 defines amino acids at positions 2, 3, 4, 7, 10, 11, 12, 14 and 15, where for 11 antibodies, there were 3 or less variants at these positions.

In a preferred embodiment an antibody is chosen for the treatment, prevention or diagnosis of cancer based on having a heavy chain CDR3 that is at least 90% identical to a CDR3 comprising the following amino acids at the specified positions: G, L, or N at position 2, G, T, or Y at position 3, G or T at position 4, Y at position 7, Y, A, or G at position 10, M, D or F at position 11, D or E at position 12 and AY at position 14-15.

Whereas Light Chain CDR1 for MNC2 is RASKS--VSTSGYSYMH (SEQ ID NO: 173), with the amino acids numbered from left to right 1 through 17, the consensus sequence of MNC2, MNE6, 20A10, 3C2B1 and new antibodies B2, B7, 8C7F3, H11 and B9 is:

K or R at position 1, A or S at position 2, S or R at position 3, K, Q or A at position 4, S, N or T at position 5, V, I, E, or K at position 6, L, V or S at position 7, S, Y, I or V at position 8, A, S, or H at position 9, T or S at position 10, N, S, or Y at position 11, G, S, D, or Q at position 12, V, Y, K or N at position 13, N, S, or T at position 14, Y or F at position 15, and I, L or M at position 16, and H, A, E or Q at position 17. The underlined amino acids indicate how this more inclusive consensus sequence differs from the consensus sequence generated for MNC2, MNE6, 20A10 and 3C2B1 alone. Of the 17 amino acids in light chain CDR1, the consensus sequence for all nine antibodies differs from the consensus sequence for the original cancer-specific four by 13 amino acids. 4 of the 13 are homologous substitutions, which in general do not significantly alter the structure or specificity of the protein. Of the remaining 9 substitutions, 1 is at position 4, 1 is at position 5, 3 are at position 6, 1 is at position 7, 1 is at position 11, and 2 are at is at position 17. The inclusion of the 5 new antibodies did not alter the amino acids, excluding homologous substitutions, at positions 1, 2, 3, 8, 9, 10, 12, 13, 14, 15 or 16. For this reason, we conclude that the conserved consensus sequence for light chain CDR1 that defines a MUC1* cancer-specific antibody comprises the amino acids given above for positions 1, 2, 3, 8, 10, 12, 13, 14, 15 and 16.

Analysis of the consensus sequence generated with all the antibodies, including 5C6F3 and 25E6 further altered the consensus sequence for light chain CDR1 with amino acid substitutions as follows: L at position 6; D at position 9; D at position 11 and N at position 17. We note that none of these substitutions were at positions that were invariant for the original four cancer-specific antibodies plus the five new antibodies. Thus, we conclude that a conserved consensus sequence for light chain CDR1 that defines at least 90% identity of a cancer-specific antibody comprises amino acids defined above at positions 1, 2, 3, 8, 10, 12, 13, 14, 15 and 16.

In a preferred embodiment an antibody is chosen for the treatment, prevention or diagnosis of cancer based on having a light chain CDR1 that is at least 90% identical to a CDR1 comprising K or R at position 1, A or S at position 2, S or R at position 3, S, Y, I or V at position 8, T or S at position 10, G, S, D, or Q at position 12, V, Y, K or N at position 13, N, S, or T at position 14, Y or F at position 15, and I, L or M at position 16.

Whereas Light Chain CDR2 for MNC2 is LASNLES (SEQ ID NO: 177), with the amino acids numbered from left to right 1 through 7, the consensus sequence of MNC2, MNE6, 20A10, 3C2B1 and new antibodies B2, B7, 8C7F3, H11 and B9 is: L, W, S, T or K at position 1, A, T or V at position 2, S at position 3, N or T at position 4, L or R at position 5, E, A, F or D at position 6, and S at position 7. The underlined amino acids indicate how this more inclusive consensus sequence differs from the consensus sequence generated for MNC2, MNE6, 20A10 and 3C2B1 alone.

In a preferred embodiment an antibody is chosen for the treatment, prevention or diagnosis of cancer based on having a light chain CDR2 that is at least 90% identical to a CDR2 comprising the following amino acids at the specified positions: L, W, S, T or K at position 1, A, T or V at position 2, S at position 3, N or T at position 4, L or R at position 5, E, A, F or D at position 6, and S at position 7. Of the 7 positions, the inclusion of the five new antibodies introduced 5 substitutions of which only 2 were not homologous substitutions.

Analysis of the consensus sequence generated with all the antibodies, including 5C6F3 and 25E6 further altered the consensus sequence for light chain CDR2 with amino acid substitutions as follows: K at position 4, which is a substitution that is homologous to N.

In a preferred embodiment an antibody is chosen for the treatment, prevention or diagnosis of cancer based on having a light chain CDR2 that is at least 90% identical to a CDR2 comprising: A, T or V at position 2, S at position 3, N, T, or K at position 4, L or R at position 5, E, A, F or D at position 6, and S at position 7.

Whereas Light Chain CDR3 for MNC2 is QHSRELPFT (SEQ ID NO: 181), with the amino acids numbered from left to right 1 through 9, t the consensus sequence of MNC2, MNE6, 20A10, 3C2B1 and new antibodies B2, B7, 8C7F3, H11 and B9 is: Q or F at position 1, H or Q at position 2, S, Q, R, D or N at position 3, R, S, Y or N at position 4, E, L, S or H at position 5, L, S, V, D or Y at position 6, P or S at position 7, F, L or P at position 8 and T at position 9. The underlined amino acids indicate how this more inclusive consensus sequence differs from the consensus sequence generated for MNC2, MNE6, 20A10 and 3C2B1 alone.

Analysis of the consensus sequence generated with all the antibodies, including 5C6F3 and 25E6 further altered the consensus sequence for light chain CDR2 with amino acid substitutions as follows: W at position 1; G at position 3; T at position 4; F at position 5; Q at position 8.

In a preferred embodiment an antibody is chosen for the treatment, prevention or diagnosis of cancer based on having a light chain CDR3 that is at least 90% identical to a CDR2 comprising: Q, F or W at position 1, H or Q at position 2, R, S, T, Y or N at position 4, E, L, S or H at position 5, L, S, V, D or Y at position 6, P or S at position 7, and T at position 9.

Other General Strategy for Using Antibodies, Antibody Fragments and CARs that Target the Extracellular Domain of MUC1*

In another aspect, the invention is directed to a composition that includes at least two different plasmids transfected into the same immune cell, wherein the first encodes a CAR comprising an antibody fragment, scFv, or peptide that binds to a tumor antigen and the other encodes a gene that is not a CAR, wherein the gene that is not a CAR is expressed from an inducible promoter that is activated by elements of an activated immune cell. In one aspect, the immune cell is a T cell or an NK cell. In one aspect the CAR comprises an antibody fragment, scFv or peptide that binds to the extra cellular domain of MUC1*. In one aspect the CAR comprises an scFv derived from MNC2, MNE6, 20A10, 3C2B1, 5C6F3, 25E6, 18G12, 28F9, 1E4, B12, B2, B7, B9, 8C7F3, or H11. In one aspect the non-CAR species is a cleavage enzyme. In one aspect the cleavage enzyme is MMP2, MMP3, MMP9, MMP13, MMP14, MMP16, ADAM10, ADAM17, ADAM28 or catalytically active fragments thereof. In another aspect the non-CAR species is a cytokine. In one aspect, the Cytokine is IL-7. In one aspect the cytokine is IL-15. In one aspect the cytokine is IL-12. In one aspect the cytokine is IL-18. The sequence of an activated IL-18 is given (SEQ ID NOS: 1637-1638). Two examples of NFAT-inducible IL-18 embedded in the Foxp3 enhancer region are given (SEQ ID NOS: 1639-1640). Two examples of NFAT-inducible IL-18 embedded in the IL-2 enhancer region are given (SEQ ID NOS: 1641-1642). In one case, there are three (3) NFAT response elements and in the other case there are six (6) NFAT response elements. The number of NFAT response elements can be varied in order to get the desired amount of IL-18 expressed upon CAR T cell recognition of the target. Examples of antibodies of the invention incorporated into CARS with inducible IL-18 are shown as: murine or human MNC2 in a CAR with a 4-1BB or CD28 co-stimulatory domain plus inducible IL-18 (SEQ ID NOS: 1643-1646), or also with a 1XX mutated CD3-zeta (SEQ ID NOS: 1647-1650); murine or human MNE6 in a CAR with a 4-1BB or CD28 co-stimulatory domain plus inducible IL-18 (SEQ ID NOS: 1651-1654), or also with a 1XX mutated CD3-zeta (SEQ ID NOS: 1655-1658); murine or human 20A10 in a CAR with a 4-1BB or CD28 co-stimulatory domain plus inducible IL-18 (SEQ ID NOS: 1659-1662), or also with a 1XX mutated CD3-zeta (SEQ ID NOS: 1663-1666); murine or human 25E6 in a CAR with a 4-1BB or CD28 co-stimulatory domain plus inducible IL-18 (SEQ ID NOS: 1667-1670), or also with a 1XX mutated CD3-zeta (SEQ ID NOS: 1671-1674). In another aspect the cytokine is IL-7 and IL-15. In one case expression of the non-CAR species is induced by elements of an activated immune cell. In one aspect the element of an activated immune cell is an NFAT. In one aspect the NFAT is NFATc1, NFATc3 or NFATc2. Cytokines IL-7, IL-15, IL-12 and IL-18 are known to promote T cell persistence. In one aspect of the invention an immune cell described above is administered to a patient for the treatment or prevention of cancer. In one aspect of the invention, the cancer is a MUC1 positive cancer or a MUC1* positive cancer.

In addition to making CAR T cells that also induce expression of a cleavage enzyme, we made CAR T cells that also induce local and transient expression of IL-18. Many of the T cell based inducible systems reported insert the gene to be inducibly expressed into an IL-2 promoter or enhancer.

We compared inducible expression off an IL-2 promoter/enhancer to inducible expression off of a portion of the Foxp3 enhancer. In this particular example, human T cells were transduced with both huMNC2-CAR44 and an NFAT inducible IL-18, wherein the Il-18 gene was either inserted into an IL-2 promoter or the Foxp3 enhancer region. It is known in the field that a major problem with CAR Ts with inducible second factors is that the second factor is leaky, meaning that significant expression of the second factor occurs without activation of the CAR T cell. The other problem with existing inducible systems is the length of time that goes by between when the CAR T cell is activated and the second factor is induced is typically very long so that the cell secreting the second factor may be far away from the tumor by the time the second factor is expressed.

FIG. 211A-211C show graphs of an ELISA experiment measuring the amount of IL-18 secreted into the condition media of huMNC2-CAR44 T cells, which also bear an NFAT inducible IL-18, co-cultured with MUC1* positive cancer cells. As a method of inducing varying levels of IL-18 expression, we co-cultured the CAR T cells with cancer cells doped with increasing amounts of cells that were engineered to express even more MUC1*. In these figures we show T47D cancer cells that are either wild-type, or doped with 5%, 10% or 30% of the T47D cells expressing more MUC1*. FIG. 211A shows the graph of IL-18 secreted into the supernatant of T47D breast cancer cells co-cultured with untransduced human T cells. FIG. 211B shows the graph of IL-18 secreted into the supernatant of T47D breast cancer cells co-cultured with huMNC2-CAR44 T cells that also bore an NFAT inducible IL-18 gene inserted into a portion of the Foxp3 enhancer. FIG. 211C shows the graph of IL-18 secreted into the supernatant of T47D breast cancer cells co-cultured with huMNC2-CAR44 T cells that also bore an NFAT inducible IL-18 gene inserted into a portion of the IL-2 enhancer. As can be seen in the figure, the Foxp3 system induces rapid and robust expression of IL-18, which is significantly faster and higher than that of the same construct in an IL-2 promoter. In this example, the IL-18 gene is inserted downstream of six (6) NFAT response elements, however one can attenuate the amount of the second factor by using a lesser number of response elements or enhance the amount by increasing the number of NFAT response elements.

It has been reported that IL-18 increases persistence of CAR T cells in vivo. However, we observed an unexpected result. In a dose-dependent manner, secretion of IL-18 increased the killing of low antigen density cells by the CAR T cells. We differentially labeled the T47D-wt cells (red: mCherry) and those T47Ds that were transduced to express more MUC1* (green: GFP). FIG. 212A-212X shows photographs of T47D breast cancer cells (red) doped with varying percentages of T47D cells engineered to express more MUC1* (green). The target cancer cells have been co-cultured with huMNC2-CAR44 T cells with NFAT inducible IL-18 wherein the IL-18 gene has been inserted into either the Foxp3 enhancer/promoter or the IL-2 enhancer/promoter. FIGS. 212A-212C, 212I-212K, and 212Q-212S show the cancer cells co-cultured with untransduced T cells. FIGS. 212D-212F, 212L-212N, and 212T-212V show the cancer cells co-cultured with hiMNC2-CAR44 T cells with the NFAT inducible IL-18 gene inserted into the Foxp3 enhancer/promoter. FIGS. 212G-212H, 212O-212P, and 212W-212X show the cancer cells co-cultured with hiMNC2-CAR44 T cells with the NFAT inducible IL-18 gene inserted into the IL-2 enhancer/promoter. As can be seen in the figure, the low antigen density T47D-wt type cells (red) are being killed when doped with higher percentages of cells that express more MUC1* and thus secrete more IL-18. The experiment shows that this is not just a bystander effect, because the cells expressing IL-18 off of the IL-2 promoter, which expresses much lower levels of IL-18, do not kill the low antigen density cells even when they are doped with 30% cells expressing more MUC1*.

We then showed that the CAR T mediated killing is specific for the CAR T specific antigen. We performed a similar experiment, wherein control, MUC1/MUC1* negative cells were doped with 5%, 10% or 30% of the T47D cells expressing more MUC1*, and co-cultured with MUC1* specific CAR T cells. FIG. 213A-213B shows graphs of ELISA experiments in which levels of IL-18 secreted into the conditioned media are measured for huMNC1-CAR44 T cells with NFAT inducible IL-18 gene, inserted into the Foxp3 enhancer or promoter, co-cultured with either MUC1* positive cancer cells or MUC1 negative non-cancerous cells. FIG. 213A shows IL-18 secretion from huMNC2-CAR44 T cells with NFAT inducible IL-18 in co-culture with T47D breast cancer cells where the population has been doped with 5%, 10% or 30% T47D cells that had been transfected with even more MUC1*. FIG. 213B shows IL-18 secretion from huMNC2-CAR44 T cells with NFAT inducible IL-18 in co-culture with non-cancerous, MUC1 negative HEK293 cells where the cell population has been doped with 5%, 10% or 30% T47D cells that had been transfected with more MUC1*. As can be seen in the figure, the amount of IL-18 secreted into the media can be attributed to the MUC1* positive cells that the population was doped with. Time course fluorescent photographs of the experiment show that even when doped with significant percentages of high antigen density MUC1* positive cells, the MUC1 negative cells are not killed by the MUC1* targeting CAR T cells. FIG. 214A-214X shows photographs of T47D breast cancer cells (red) or non-cancerous HEK293 cells (also red), where both cell types have been doped with varying percentages of T47D cells engineered to express more MUC1* (green). These target cancer cells have been co-cultured with huMNC2-CAR44 T cells with NFAT inducible IL-18 wherein the IL-18 gene has been inserted into the Foxp3 enhancer/promoter. FIG. 214A-214F shows either T47D cells or HEK293 cells that have not been doped with T47D cells engineered to express high MUC1* density. FIG. 214G-214L shows either T47D cells or HEK293 cells that have been doped with 5% T47D cells engineered to express high MUC1* density. FIG. 214M-214R shows either T47D cells or HEK293 cells that have been doped with 10% T47D cells engineered to express high MUC1* density. FIG. 214S-214X shows either T47D cells or HEK293 cells that have been doped with 30% T47D cells engineered to express high MUC1* density. FIGS. 214A-B, G-H, M-N, and S-T show T47D breast cancer cells. FIGS. 214C-F, I-L, O-R, and U-X show HEK293 cells. As can be seen in the figures, the induced secretion of IL-18 resulted in low MUC1* density T47D cells being killed but did not induce non-specific killing of the MUC1* negative HEK293 cells. Taken together these results show that the Foxp3 system is a superior system for the inducible expression of a second factor and especially useful in CAR T systems. Further we have demonstrated the unexpected result that IL-18 increases the killing of low antigen density cells without the unwanted effect of killing nearby MUC1/MUC1* negative cells.

In another aspect, the invention is directed to a composition that includes at least two different plasmids trans-fected into the same immune cell, wherein the first encodes a CAR comprising an antibody fragment, scFv or peptide that binds to the extra cellular domain of an antigen on the surface of a B cell and the other encodes a gene that is not a CAR, wherein the gene that is not a CAR is expressed from an inducible promoter that is activated by elements of an activated immune cell. In one aspect, the immune cell is a T cell or an NK cell. In one aspect the CAR comprises an antibody fragment, scFv or peptide that binds to CD19. In another aspect the antibody fragment, scFv or peptide binds to a surface antigen of a B cell or a B cell precursor, or binds to CD19, CD20, CD22, BCMA, CD30, CD138, CD123, CD33 or LeY antigen. In one aspect the non-CAR species is a cleavage enzyme. In another aspect the non-CAR species is a cytokine. In one aspect, the Cytokine is IL-7. In one aspect the cytokine is IL-15. In another aspect the cytokine is IL-7 and IL-15. In one case expression of the non-CAR species is induced by elements of an activated immune cell. In one aspect the element of an activated immune cell is an NFAT. In one aspect the NFAT is NFATc1, NFATc3 or NFATc2. that is not a CAR, wherein the gene that is not a CAR is expressed from an inducible promoter wherein expression is induced by elements of an activated immune cell. In one aspect the immune cell transfected or transduced with the composition is administered to a patient for the treatment or prevention of cancer. In one case the cancer is a leukemia, lymphoma or blood cancer.

It is not intended for the invention to be limited by a specific method or technology for inserting the gene or plasmid comprising a sequence encoding a CAR or activated T cell inducible protein or peptide there encoded. For example, the gene encoding the CARs and activated T cell induced genes described herein can be virally transduced into an immune cell using viruses, which may or may not result in the CAR gene being integrated into the genome of the recipient cell. Virus delivery systems and viral vectors include but are not limited to retroviruses, including gamma-retroviruses, lentivirus, adenoviruses, adeno-associated viruses, baculoviruses, poxvirus, herpes simplex viruses, oncolytic viruses, HF10, T-Vec and the like. In addition to viral transduction, CARs and activated T cell induced genes described herein can be directly spliced into the genome of the recipient cell using methods such as CRISPR technology, CRISPR-Cas9 and -CPF1, TALEN, Sleeping Beauty transposon system, and SB 100×.

Bulky cell surface proteins such as MUC1-FL can also cause a steric hindrance problem for BiTEs. A BiTE is a two-headed bi-specific antibody wherein one head binds to a T cell and the other head binds to a tumor-associated antigen. In this way, the BiTE links together the T cell and the tumor cells. The antibody that binds to the T cell should be an antibody that activates the T cell, such as an antibody against CD3 or CD28. To solve the steric hindrance problem, the linker between the T cell specific antibody and the tumor specific antibody is lengthened.

In another aspect of the invention, an anti-MUC1* single chain molecule is fused to a cleavage enzyme or a catalytically active fragment of a cleavage enzyme. In one aspect of the invention, the cleavage enzyme is MMP9 (SEQ ID NO:643). In another aspect of the invention, the enzyme is a catalytically active fragment of MMP9 (SEQ ID NO:645). In some cases, the antibody fragment of the CAR is chosen for its ability to recognize MUC1* when cleaved by that specific cleavage enzyme. In one embodiment, the cleavage enzyme is MMP9, MMP3, MMP14, MMP2, ADAM17, ADAM TS16, and/or ADAM28. In one embodiment, the antibody or antibody fragment binds to a peptide having the sequence of (PSMGFR) GTINVHDVETQFNQYKTEAAS-RYNLTISDVSVSDVPFPFSAQSGA (SEQ ID NO: 2), PSMGFR N-10, QFNQYKTEAAS-RYNLTISDVSVSDVPFPFSAQSGA (SEQ ID NO: 3), or PSMGFR N+20 SNIKFRPGSVVVQLTLAFREGT-INVHDVETQFNQYKTEAAS-RYNLTISDVSVSDVPFPFS AQSGA (SEQ ID NO: 822). In another embodiment, cleavage enzymes MMP9 and MMP3 are transduced into a T cell that is also transduced with a CAR with an antibody fragment that is a fragment of MNC2.

In many cases it is desirable to have the cleavage enzyme expressed only after an immune cell recognizes the tumor-associated target on a solid tumor. In this way, the cleavage enzyme will not freely move throughout the body, cleaving MUC1, MUC16 or other proteins, wherein their cleavage could actually promote cancer. However, there are cancers that are physically accessible to direct application of chemotherapy agents, CAR T cells and other anti-cancer agents. For example, types of brain cancers, prostate cancer and ovarian cancers have all shown the benefit of direct application of anti-cancer agents into the local vicinity of the cancer. CAR T cells have been injected directly into the brain and/or cerebral spinal fluid of glioblastoma patients. Radiation has been directed to the prostate area for the treatment of prostate cancers, including those that have metastasized. Hot chemo therapy agents have been directly injected into the intraperitoneal cavity for the treatment of ovarian cancers. In these and other cases, where the cancers that are physically accessible to direct application of chemotherapy agents, a cleavage enzyme is administered in the presence or absence of another anti-cancer agent, which could be a CAR T cell, an immune cell engineered to recognize a tumor-associated antigen, a BiTE, an ADC, a biological or a standard chemotherapy agent. Although ovarian cancer can metastasize to anywhere in the body, it usually stays in the abdomen as it spreads to adjacent organs, such as the intestines, liver and stomach. This makes ovarian cancer an ideal test case for improving the effect of anti-cancer agents by administering a cleavage enzyme in combination with other anti-cancer agents, including a platinum-based drug such as carboplatin (Paraplatin®) or cisplatin, and/or a taxane such as paclitaxel (Taxol®) or docetaxel (Taxotere®). Alkeran (Melphalan), Avastin® (Bevacizumab), Carboplatin, Clafen® (Cyclophosphamide), and Cytoxan have all been approved for the treatment of ovarian cancer. Other treatments that are being tested for the treatment of ovarian cancers include agents that target MUC1, MUC16 and as described herein, MUC1*.

Other cleavage enzymes can be used in addition to or in place of MMP9. MMP14 for example, has been shown to efficiently cleave MUC1 to MUC1* (FIG. 38). In one aspect of the invention, MMP14 is expressed in an immune cell that is also engineered to express a CAR. In one case the CAR is an anti-MUC1* CAR. For example, it can be an MNC2-CAR44 transduced T cell. In another aspect of the invention, the MMP14 is directly administered to the patient either in the location of the tumor or by i.v.

In yet another aspect of the invention, the cancer is an ovarian cancer and either MMP9 or MMP14 is directly injected into the abdominal area along with an anti-cancer agent, which can be a chemotherapy agent, a biological, an anti-MUC1* CAR T or an anti-MUC16 CAR T.

In addition to local administration of the cleavage enzyme, +iv administration alone or secreted from an immune cell, which may be a CAR T cell, which further may be expressed off of an inducible promoter is contemplated.

Methods Used in Carrying Out Experimentation in Relation to the Present Invention
1. Lentivirus Production and Viral Transduction of Immune Cells
HEK293 or HEK293T cells (ATCC) were used to produce lentivirus. The day prior transfection plates (6well plate) were coated with poly-D-lysine and cells seeded so that cell density reaches 90-95% at the time of transfection and cultures in a 5% $CO_2$ atmosphere. The next day cells were transfected with Lipofectamine 3000 (life technologies) and Opti-MEM® I Reduced Serum Medium according to the manufacturer instructions (0.75 ug of lentiviral expression vector and 2.25 ug of pPACKHI packaging mix was used). After 6 h incubation, the media was changed and media containing lentivirus was harvested after 24 and 48 hours. Lentivirus was concentrated with Lenti-X concentrator (Clontech) and titer was calculated using the Lenti-X p@4 Rapid Titer Kit (Clontech). Lentivirus was store at −80 C in single-use aliquots.
Transduction of Immune Cells with Constructs Including CARs
Human T cells, if frozen, were thawed and pre-warmed in 100-200 units IL-2 and TexMACS™ medium, 20 ml, and pelleted by centrifugation. Cells were resuspended in 10 ml of medium and cultured at 37° C., 5% $CO_2$ at $1×10^6$ cells/ml in complete medium with anti-CD3/anti-CD28 beads (TransAct™ kit).
After 4 days in culture, cells were counted and 450 ul of cell suspension was placed in single well of a 24-well plate at a density of approximately $1×10^6$ cells/ml. Cells were allowed to settle. 150 ul was carefully removed from the top of each well. To each well was added an appropriate dilution of lentiviral vector, diluted in plain TexMACS™ medium, along with protamine sulfate to a final concentration of 10 ug/ml, in a 150 ul volume, for a final total volume of 450 ul per well and incubated for 24 hrs. Transduced cells were removed, pelleted by centrifugation, and resuspended in fresh medium, adjusting cell density, not to exceed $1.0×10^6$ cells/ml. Transduced T cells can be expanded and frozen or used directly. Typically transduced T cells are used or frozen between Day 7 and Day 20 post activation with IL-2 and TransAct™ media.
2. Comparing Anti-MUC1* CAR T Cell Activity in the Presence or Absence of Exogenous Cleavage Enzymes
Human T cells (ALLCELLS) were transduced with huMNC2-CAR44 or huMNC2-CAR50. CAR44 is huMNC2-scFv-CD8-CD8 (transmembrane-41BB-3z). CAR50 is the same as CAR44 except that CAR50 has a murine MNC2-scFv and a CD4 transmembrane domain. The CAR T cells were incubated for 18 hours with target and non-target cells that have been dyed red using CMTMR. When T cells recognize a target cell, they cluster the target cells and begin to kill them. As can be seen in FIGS. 45-47 the CAR T cells effectively cluster and kill the target MUC1* positive cancer cells. FIG. 45 shows huMNC2-CAR44 or huMNC2-CAR50 T cells being co-cultured with HCT-116 cells transduced to express MUC1*, "HCT-MUC1*" or with HCT-116 cells transduced with a full-length MUC1, "HCT-MUC1-41TR". Recall that MNC2 recognizes an ectopic epitope that is only revealed after cleavage and release of the MUC1 tandem repeat domain. Neither huMNC2-CAR44 nor huMNC2-CAR50 T cells recognize the cells expressing full-length MUC1 (FIG. 45F-45H). However, when MMP9 plus activator APMA is added, the CAR T cells recognize the cells, cluster and kill them (FIG. 45J-45L). The addition of cleavage enzyme ADAM-17 did not affect the recognition of either CAR T cell for full-length MUC1 (FIG. 45N-45P). The reason could be that ADAM-17 doesn't cleave MUC1 or the cleavage product is not recognized by MNC2. A similar experiment was performed (FIG. 46) that showed that MMP2 was only weakly effective at either cleavage MUC1 or that the MMP2 cleavage product was only weakly recognized by MNC2. FIG. 47 shows the contrast between huMNC2-CAR44 recognition of HCT-MUC1* cells, T47D-wt breast cancer cells, and T47D cells with added MMP9 which presumably cleaves the full-length MUC1 to an MNC2 recognizable MUC1*.

3. Confocal Imaging of CAR T Cells Giving the "Kiss of Death" to MUC1* Positive Cancer Cells.

Confocal images of Human T cells that were transduced with huMNC2-CAR44, co-cultured for 24 hours with MUC1* positive DU145 prostate cancer cells showed the CAR T cells inserting Granzyme B into the target cancer cells. FIG. 55 shows fluorescent images of the huMNC2-CAR44 T cells secreting Granzyme B when co-cultured with the prostate cancer cells, FACS analysis showing increased expression of Granzyme B by the CAR T cells and an xCELLigence experiment showing that the target prostate cancer cells were in fact killed.

5. Analysis of CAR T Cell Induced Killing of MUC1* Positive Cancer Cells by FACS Analysis We have demonstrated the killing effect of huMNC2-CAR44 T cells on T47D MUC1* positive breast cancer cells, wherein the breast cancer cells have been transfected with increasing amounts of additional MUC1*. The killing effect of the huMNC2-CAR44 T cells increases as the amount of target MUC1* expressed on the cells increases.

IFN-γ secretion in media was measured using a human IFN-γ ELISA kit (Biolegend). Plates were coated with an anti-IFN-γ antibody (capture antibody, 1× in coating buffer). After overnight incubation at 4° C., the plate was washed 4 times with PBS-T and blocking solution was added to block remaining binding site on the well. After 1 h at RT (shaking at 500 rpm) the plate was washed 4 times with PBS-T and conditioned media (CM) and IFN-γ standard, was added. After 2 h at RT with shaking, the plate was washed 4 times with PBS-T and detection antibody (1×), was added. After 1 h at RT with shaking, the plate was washed 4 times with PBS-T and Avidin-HRP (1×) was added. After 30 min at RT with shaking, the plate was washed 5 times with PBS-T (soak 1 min each wash) and TMB substrate solution was added. The reaction was stopped after 20 min by adding the stop solution and absorbance was read at 450 nm (minus absorbance at 570 nm) within 15 min of stopping.

6. Analysis of CAR T Cell Induced Killing of MUC1* Positive Cancer Cells by xCELLigence In addition to FACS analysis, many researchers now use an xCELLigence instrument to measure CAR T killing of cancer cells. The xCELLigence instrument uses electrode arrays upon which cancer cells are plated. The adherent cancer cells insulate the electrode and so cause an increase in impedance as they grow. Conversely, T cells are not adherent and remain in suspension so do not contribute to insulation of the electrode which would increase impedance. However, if the T cells or CAR T cells kill the cancer cells on the electrode plate, the cancer cells ball up and float off as they die, which causes the impedance to decrease. The xCELLigence instrument measures impedance as a function of time, which is correlated to cancer cell killing. In addition, the electrode plates also have a viewing window. When CAR T cells effectively kill the adsorbed target cancer cells, there is a decrease in impedance but also one can see that there are no cancer cells left on the plate surface.

In most of the XCELLigence experiments, 5,000 cancer cells were plated per well of a 96-well electrode array plate. Cells were allowed to adhere and grow for 24 hours. CAR T cells were then added at an Effector to Target ratio (E: T) of 0.5:1, 1:1, 2:1, 5:1, 10:1 and sometimes 20:1. The E: T ratio assumes 100% transduction of the CAR into the T cells, when the actual transduction efficiency is 40%.

The xCELLigence instrument records impedance as a function of time and experiments can go on for up to 7 days.

FIG. 48, FIG. 49, FIG. 55H, FIG. 56H, FIGS. 57A-57C, all show results of CAR T and cancer cell experiments performed on an xCELLigence instrument.

7. Anti-MUC1* CAR T Cell Therapy in Mice Bearing Human Tumors

Female NOD/SCID/GAMMA (NSG) mice between 8-12 weeks of age were implanted with 500,000 human cancer cells, wherein the cancer cells had previously been stably transfected with Luciferase. Mice bearing Luciferase positive cells can be injected with the enzyme's substrate Luciferin just prior to imaging, which makes the cancer cells fluoresce. The cancer cells are imaged in live mice within 10-15 minutes after injection with Luciferin on an IVIS instrument. The readout is flux or photons per second. Tumors were allowed to engraft until tumors were clearly visible by IVIS.

FIGS. 58A-58F show fluorescent photographs of mice taken on an IVIS instrument. 10 minutes prior to IVIS photographs, mice were injected intraperitoneally (IP) with Luciferin, which fluoresces after cleavage by Luciferase, thus making tumor cells fluoresce. NSG (NOD/SCID/GAMMA) immune compromised mice that on Day 0 were subcutaneously implanted on the flank with 500,000 human MUC1* positive cancer cells that had been stably transfected with Luciferase. Tumors were allowed to engraft. On Day 7 after IVIS measurement, animals were tail vein injected with either PBS, 10 million untransduced human T cells or 8.5M huMNC2-scFv-CAR44 T cells. As can be seen in the figure, control mice had to be sacrificed on Day 20 due to excess tumor burden (FIG. 58A-58B). huMNC2-CAR44 T cell treated mice were tumor free after a single CAR T cell injection until Day 100 when they were sacrificed (FIG. 58C). FIG. 58E shows Kaplan-Meier survival curves that demonstrate the efficacy of T cell therapy guided by anti-MUC1* antibody. FIG. 58F shows a table summarizing the characteristics of the human T cells that were collected from the test mice upon sacrifice. The starting Car T cell population was 50% CD4 positive helper T cells and 50% CD8 positive killer T cells. As can be seen in the table, the percent of CD8 positive cells has increased in the CAR T treated group, indicating in vivo expansion of that group of cells, which is an indicator of efficacy. We also note that in the treated group, the CAR T cells express higher levels of PD1 which is a marker of T cell exhaustion.

In another animal experiment, NSG mice were subcutaneously implanted into the flank with 500,000 tumor cells then injected on Day 7 and again on Day 14 with either saline solution, PBS, or 10M huMNC2-CAR44 T cells (FIG. 59A-59C). In this experiment the amount of MUC1* expressed on the tumor cells was varied. In one case, the tumor cells that were implanted were T47D-wildtype (FIG. 59B). In another case, the T47D cells were doped with 95% T47D cells that had been transfected to express even more MUC1* (FIG. 59C). As can be seen, the tumors comprised of cells expressing more MUC1* were eliminated more quickly and did not recur. In a similar experiment, the tumor cells were doped with a relatively small amount of cells that expressed more MUC1*. FIG. 60A-60C shows NSG mice implanted with T47D-wt breast cancer cells that have been doped with 30% of T47D cells transfected to express more MUC1*. As can be seen, even a small percentage of cells expressing high levels of MUC1* is sufficient to trigger CAR T cell mediated killing of the entire tumor. Naturally occurring tumors are heterogeneous and are comprised of both high and low antigen expressing cells. This experiment indicates that huMNC2-CAR44 T cells would be effective in eradicating naturally occurring tumors.

FIGS. 61A-61J show fluorescent photographs of mice taken on an IVIS instrument. NSG (NOD/SCID/GAMMA) immune compromised mice that on Day 0 were subcutaneously injected into the flank with 500K human BT-20 cells which are a MUC1* positive triple negative breast cancer cell line. The cancer cells had been stably transfected with Luciferase. Tumors were allowed to engraft. On Day 6 after IVIS measurement, animals were given a one-time injection of 10 million of either human T cells transduced with huMNC2-scFv-CAR44 or untransduced T cells. 5 million T cells were injected intra-tumor and 5 million were injected into the tail vein. 10 minutes prior to IVIS photographs, mice were IP injected with Luciferin. In one case the huMNC2-CAR44 T cells were first incubated with beads to which was attached the PSMGFR peptide to pre-stimulate the T cells and in the figure is marked Protocol 1. In Protocol 2, the huMNC2-CAR44 T cells were pre-stimulated with live tumor cells, which likely injected more tumor cells into the animals' circulation.

FIGS. 62A-62M show fluorescent photographs of mice taken on an IVIS instrument. NSG (NOD/SCID/GAMMA) immune compromised mice that on Day 0 were injected into the intraperitoneal cavity (IP) with 500K human SKOV-3 cells which are a MUC1* positive ovarian cancer cell line. The cancer cells had been stably transfected with Luciferase. Tumors were allowed to engraft. On Day 3 after IVIS measurement, animals were IP injected with 10M either human T cells transduced with huMNC2-CAR44 T cells, untransduced T cells or PBS. Animals were IVIS imaged again on Day 7. 10 minutes prior to IVIS photographs, mice were IP injected with Luciferin. As can be seen in the figure the anti-MUC1* CAR T cells effectively reduced ovarian tumor volume by Day 15.

9. NFAT-Induced IL-18 Sequences and Cloning

Cloning of IL 18 in pGL4-14 3×NFAT:

An activated IL18 (SEQ ID NO:1644) was synthesized with the CD8 leader sequence. The pGL4-14 3×IL2 NFAT and pGL4-14 3×FoxP3 NFAT were digested with XhoI and HindIII restriction enzymes (New England Biolabs). The purified plasmids and the synthesized IL18 sequences were assembled using the Gibson assembly cloning kit (New England Biolab). The resulting constructs (pGL4-14 3×IL2NFAT-IL18 and pGL4-14 3×FoxP3NFAT-IL18) contains 3 repeats of NFAT response element (IL2 or FoxP3) followed by a minimum promoter (mCMV: SEQ ID NO:1634) and IL18 (SEQ ID NOS: 1752-1753) with CD8 leader sequence.

Cloning of MNC2 CAR with IL18 in pCDNA Vector:

MNC2 CAR sequence was amplified from previously made vector by polymerase chain reaction (PCR) using the following primers: 5'-agggagacccaagctggctagttaagcttg-gatggccttaccagtgaccgccttgc-3' (SEQ ID NO:1754) and 5'-taggccagagaaatgttctggcattatcagcgaggggggcagggcctgc-3' (SEQ ID NO:1755).

IL18 sequence including NFAT response element was amplify from pGL4-14 3×NFAT-IL18 by polymerase chain reaction (PCR) using the following primers: 5'-tgccagaacat-ttctctgg-3' (SEQ ID NO:1756) and 5'-acagtcgaggctgatcagcgggtttaaacttatcagtcctcgttctgcacgg-3' (SEQ ID NO: 1757). The purified PCR fragments and digested pCDNA 3.1 V5 (ThermoFisher scientific) were assembled using the Gibson assembly cloning kit (New England Biolab) to create the construct pCDNA MNC2CAR-3×IL2NFAT-IL18 and pCDNA MNC2CAR-3×FoxP3NFAT-IL18.

Cloning of MNC2 CAR-NFAT-IL18 in lentivector:

MNC2 CAR-NFAT-IL18 sequence was amplified from pCDNA MNC2CAR-3×IL2NFAT-IL18 and pCDNA MNC2CAR-3×FoxP3NFAT-IL18. by polymerase chain reaction (PCR) using the following primers: 5'-atgcaggccctgcccctcgctgataagtttaaactgccagaacat-ttctctggcctaac-3' (SEQ ID NO:1758) and 5'-accggagc-gatcgcagatccttcgcggccgcttatcagtcctcgttctgcacggtgaac-3' (SEQ ID NO:1759). The purified PCR fragments and digested pCDH Dual Hygro (System Biosciences, CA) were assembled using the Gibson assembly cloning kit (New England Biolab) to create the construct pCDH MNC2CAR-3×IL2NFAT-IL18 and pCDH MNC2CAR-3×FoxP3NFAT-IL18.

Creation of Lentivector with MSCV Promoter

MSCV promoter sequence was amplified from pCDH-MSCV-MCS-EF1a-GFP (System Biosciences). by polymerase chain reaction (PCR) using the following primers: 5'-attgcactagttgaaagaccccacctgtagg-3' (SED ID NO: 1760) and 5'-aatgctctagaatacgggtatccagg-3' (SEQ ID NO:1761). After digestion with SpeI and XbaI restriction enzymes (New England Biolabs), the purified fragment was cloned into pCDH CMV MCS (System Bioscience) digested with the same restriction enzymes to create the construct pCDH MSCV MCS.

Cloning of MNC2 CAR-NFAT-IL18 in pCDH MSCV MCS:

MNC2 CAR-IL2NFAT-IL18 sequence was amplified from pCDNA MNC2CAR-3×IL2NFAT-IL18 by polymerase chain reaction (PCR) using the following primers: 5' atagcgaattcgtaccgagggccaccatgg-3' (SEQ ID NO:1762) and 5'-taggcctcccaccgtacacgcctaggtaccacgccttctgtatg-3' (SEQ ID NO:1763) MNC2 CAR-IL2NFAT-IL18 sequence was amplified from pCDNA MNC2CAR-3×FoxP3NFAT-IL18 by polymerase chain reaction (PCR) using the following primers: 5' atagcgaattcgtaccgagggccaccatgg-3' (SEQ ID NO: 1762) and 5'-taggcctcccaccgta-cacgcctaggtacctctgcagtaaatgg-3' (SEQ ID NO:1764). After digestion with EcoRI and KpnI restriction enzymes (New England Biolabs), the purified fragment was cloned into pCDH MSCV MCS digested with the same restriction enzymes to create the construct pCDH MSCV MNC2CAR-3×IL2NFAT-IL18 and pCDH MSCV MNC2CAR-3× FoxP3NFAT-IL18.

Cloning of 6×NFAT Response Elements:

6×NFAT (IL2 and FoxP3) response element were synthesized followed by different minimal promoter: mCMV (SEQ ID NO:1634), mIL2P (SEQ ID NO:1635) and miniP (SEQ ID NO: 1636). A total of six 6 sequences were synthesized: SEQ ID NOS: 1768-1779.

6×NFAT sequences were amplified by polymerase chain reaction (PCR) using the following primers: 5'-tgccagaacat-ttctctgg-3' (SEQ ID NO:1756) and 5'-taaggccatggtggctagc-3' (SEQ ID NO: 1765). The purified PCR fragments and digested (KpnI and XhoI) pCDNA MNC2CAR 3XNFAT IL18 were assembled using the Gibson assembly cloning kit (New England Biolab) to create constructs with 6×NFAT response elements in place of the 3×NFAT response elements.

6×NFAT sequences were amplified, from the pCDNA vector created above, by polymerase chain reaction (PCR) using the following primers: 5'-aataagtttaaactgccagaacat-ttctctgg-3' (SEQ ID NO:1766) and 5'-atatagcggccgct-tatcagtcctcgttctgcacgg-3' (SEQ ID NO:1767). After diges- 5 tion with PmeI and NotI restriction enzymes (New England Biolabs), the purified fragments were cloned into pCDH MSCV MNC2CAR digested with the same restriction enzymes to create the construct pCDH MSCV MNC2CAR-6×IL2NFAT-IL18 and pCDH MSCV MNC2CAR-6×

FoxP3NFAT-IL18. For each construct 3 minimal promoter were tested.

Sequence Listing Free Text

As regards the use of nucleotide symbols other than a, g, c, t, they follow the convention set forth in WIPO Standard ST. 25, Appendix 2, Table 1, wherein k represents t or g; n represents a, c, t or g; m represents a or c; r represents a or g; s represents c or g; w represents a or t and y represents c or t.

```
MUC1 Receptor
(Mucin 1 precursor, Genbank Accession number: P15941)
                                                          (SEQ ID NO: 1)
MTPGTQSPFELLLLLTVLTVVTGSGHASSTPGGEKETSATQRSSVPSSTEKNAVSMTSSVLSSHSPGSGSSTTQGQD

VTLAPATEPASGSAATWGQDVTSVPVTRPALGSTTPPAHDVTSAPDNKPAPGSTAPPAHGVTSAPDTRPAPGSTAPP

AHGVTSAPDTRPAPGSTAPPAHGVTSAPDTRPAPGSTAPPAHGVTSAPDTRPAPGSTAPPAHGVTSAPDTRPAPGST

APPAHGVTSAPDTRPAPGSTAPPAHGVTSAPDTRPAPGSTAPPAHGVTSAPDTRPAPGSTAPPAHGVTSAPDTRPAP

GSTAPPAHGVTSAPDTRPAPGSTAPPAHGVTSAPDTRPAPGSTAPPAHGVTSAPDTRPAPGSTAPPAHGVTSAPDTR

PAPGSTAPPAHGVTSAPDTRPAPGSTAPPAHGVTSAPDTRPAPGSTAPPAHGVTSAPDTRPAPGSTAPPAHGVTSAP

DTRPAPGSTAPPAHGVTSAPDTRPAPGSTAPPAHGVTSAPDTRPAPGSTAPPAHGVTSAPDTRPAPGSTAPPAHGVT

SAPDTRPAPGSTAPPAHGVTSAPDTRPAPGSTAPPAHGVTSAPDTRPAPGSTAPPAHGVTSAPDTRPAPGSTAPPAH

GVTSAPDTRPAPGSTAPPAHGVTSAPDTRPAPGSTAPPAHGVTSAPDTRPAPGSTAPPAHGVTSAPDTRPAPGSTAP

PAHGVTSAPDTRPAPGSTAPPAHGVTSAPDTRPAPGSTAPPAHGVTSAPDTRPAPGSTAPPAHGVTSAPDTRPAPGS

TAPPAHGVTSAPDTRPAPGSTAPPAHGVTSAPDTRPAPGSTAPPAHGVTSAPDTRPAPGSTAPPAHGVTSAPDTRPA

PGSTAPPAHGVTSAPDTRPAPGSTAPPAHGVTSAPDTRPAPGSTAPPAHGVTSAPDTRPAPGSTAPPAHGVTSAPDT

RPAPGSTAPPAHGVTSAPDNRPALGSTAPPVHNVTSASGSASGSASTLVHNGTSARATTTPASKSTPFSIPSHHSDT

PTTLASHSTKTDASSTHHSSVPPLTSSNHSTSPQLSTGVSFFELSFHISNLQFNSSLEDPSTDYYQELQRDISEMEL

QTYKQGGFLGLSNIKFRPGSVVVQLTLAFREGTINVHDVETQFNQYKTEAASRYNLTISDVSVSDVPFPFSAQSGAG

VPGWGIALLVLVCVLVALAIVYLIALAVCQCRRKNYGQLDIFPARDTYHPMSEYPTYHTHGRYVPPSSTDRSPYEKV

SAGNGGSSLSYTNPAVAAASANL

PSMGFR
                                                          (SEQ ID NO: 2)
GTINVHDVETQFNQYKTEAASRYNLTISDVSVSDVPFPFSAQSGA

N-10 peptide
                                                          (SEQ ID NO: 3)
QFNQYKTEAASRYNLTISDVSVSDVPFPFSAQSGA N-19
                                                          (SEQ ID NO: 4)
ASRYNLTISDVSVSDVPFPFSAQSGA N-23
                                                          (SEQ ID NO: 5)
NLTISDVSVSDVPFPFSAQSGA N-26
                                                          (SEQ ID NO: 6)
ISDVSVSDVPFPFSAQSGA N-30
                                                          (SEQ ID NO: 7)
SVSDVPFPFSAQSGA N-10/C-5
                                                          (SEQ ID NO: 8)
QFNQYKTEAASRYNLTISDVSVSDVPFPFS
```

-continued

N-19/C-5

(SEQ ID NO: 9)

ASRYNLTISDVSVSDVPFPFS

N-36

(SEQ ID NO: 10)

FPFSAQSGA

Mouse E6 Heavy chain variable region sequence:
(DNA)

(SEQ ID NO: 12)

gaggtgaaggtggtggagtctggggggagacttagtgaagcctggagggtccctgaaactctcctgtgtagtctctgg attcactttcagtagatatggcatgtcttgggttcgccagactccaggcaagaggctggagtgggtcgcaaccatta gtggtggcggtacttacatctactatccagacagtgtgaaggggcgattcaccatctccagagacaatgccaagaac accctgtacctgcaaatgagcagtctgaagtctgaggacacagccatgtatcactgtacaagggataactacggtag gaactacgactacggtatggactactggggtcaaggaacctcagtcaccgtctcctca (amino acids)

(SEQ ID NO: 13)

EVKVVESGGDLVKPGGSLKLSCVVSGFTESRYGMSWVRQTPGKRLEWVATISGGGTYIYYPDSVKGRFTISRDNAKN

TLYLQMSSLKSEDTAMYHCTRDNYGRNYDYGMDYWGQGTSVTVSS

Mouse E6 heavy chain variable framework region 1 (FWR1) sequence:
(DNA)

(SEQ ID NO: 14)

gaggtgaaggtggtggagtctggggggagacttagtgaagcctggagggtccctgaaactctcctgtgtagtctct (amino acids)

(SEQ ID NO: 15)

EVKVVESGGDLVKPGGSLKLSCVVSGFTFS

Mouse E6 heavy chain variable complementarity determining region 1 (CDR1)
sequence:
(DNA)

(SEQ ID NO: 16)

ggattcactttcagtagatatggcatgtct (amino acids)

(SEQ ID NO: 17)

RYGMS

Mouse E6 heavy chain variable framework region 2 (FWR2) sequence:
(DNA)

(SEQ ID NO: 18)

tgggttcgccagactccaggcaagaggctggagtgggtcgca (amino acids)

(SEQ ID NO: 19)

WVRQTPGKRLEWVA

Mouse E6 heavy chain variable complementarity determining regions 2 (CDR2)
sequence:
(DNA)

(SEQ ID NO: 20)

accattagtggtggcggtacttacatctactatccagacagtgtgaagggg (amino acids)

(SEQ ID NO: 21)

TISGGGTYIYYPDSVKG

Mouse E6 heavy chain variable framework region 3 (FWR3) acid sequence:
(DNA)

(SEQ ID NO: 22)

cgattcaccatctccagagacaatgccaagaacaccctgtacctgcaaatgagcagtctgaagtctgaggacacagc catgtatcactgtacaagg (amino acids)

(SEQ ID NO: 23)

RFTISRDNAKNTLYLQMSSLKSEDTAMYHCTR

Mouse E6 heavy chain variable complementarity determining regions 3 (CDR3)
sequence:
(DNA)

(SEQ ID NO: 24)

gataactacggtaggaactacgactacggtatggactac

-continued (amino acids)
                                                                    (SEQ ID NO: 25)
DNYGRNYDYGMDY Humanized E6 heavy chain variable region sequence from IGHV3-21*03:
(DNA)
                                                                    (SEQ ID NO: 38)
gaggtgcagctggtggagtctggggagaggcctggtcaagcctggggggtccctgagactctcctgtgcagcctctgg attcaccttcagtaggtatggcatgagctgggtccgccaggctccagggaagaggctggagtgggtctcaaccatta gtggcggaggcacctacatatactacccagactcagtgaagggccgattcaccatctccagagacaacgccaagaac accctgtatctgcaaatgaacagcctgagagccgaggacacggctgtgtattactgtaccagagataactatggccg caactatgattatggcatggattattggggccagggcaccctggtgaccgtgagcagc (amino acids)
                                                                    (SEQ ID NO: 39)
EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSS

Humanized E6 heavy chain variable framework region 1 (FWR1) acid sequence:
(DNA)
                                                                    (SEQ ID NO: 40)
gaggtgcagctggtggagtctggggagaggcctggtcaagcctggggggtccctgagactctcctgtgcagcctctgg attcaccttcagt (amino acids)
                                                                    (SEQ ID NO: 41)
EVQLVESGGGLVKPGGSLRLSCAASGFTFS Humanized E6 heavy chain variable complementarity determining regions 1 (CDR1)
sequence:
(DNA)
                                                                    (SEQ ID NO: 42)
aggtatggcatgagc (amino acids)
                                                                    (SEQ ID NO: 43)
RYGMS Humanized E6 heavy chain variable framework region 2 (FWR2) acid sequence:
(DNA)
                                                                    (SEQ ID NO: 44)
tgggtccgccaggctccagggaagaggctggagtgggtctca (amino acids)
                                                                    (SEQ ID NO: 45)
WVRQAPGKRLEWVS Humanized E6 heavy chain variablecomplementarity determining regions 2
(CDR2) sequence:
(DNA)
                                                                    (SEQ ID NO: 46)
accattagtggcggaggcacctacatatactacccagactcagtgaagggc (amino acids)
                                                                    (SEQ ID NO: 47)
TISGGGTYIYYPDSVKG Humanized E6 heavy chain variable framework region 3 (FWR3) acid sequence:
(DNA)
                                                                    (SEQ ID NO: 48)
cgattcaccatctccagagacaacgccaagaacaccctgtatctgcaaatgaacagcctgagagccgaggacacggc tgtgtattactgtaccaga (amino acids)
                                                                    (SEQ ID NO: 49)
RFTISRDNAKNTLYLQMNSLRAEDTAVYYCTR Humanized E6 heavy chain variable complementarity determining regions 3
(CDR3) sequence:
(DNA)
                                                                    (SEQ ID NO: 50)
gataactatggccgcaactatgattatggcatggattat -continued (amino acids)

(SEQ ID NO: 51)

DNYGRNYDYGMDY

Humanized E6 IgG2 heavy chain synthesized by Genescript:
(DNA)

(SEQ ID NO: 52)

gaattctaagcttgggccaccatggaactggggctccgctgggttttccttgttgctatttttagaaggtgtccagtg tgaggtgcagctggtggagtctggggggaggcctggtcaagcctggggggtccctgagactctcctgtgcagcctctg gattcaccttcagtaggtatggcatgagctgggtccgccaggctccagggaagaggctggagtgggtctcaaccatt agtggcggaggcacctacatatactacccagactcagtgaagggccgattcaccatctccagagacaacgccaagaa caccctgtatctgcaaatgaacagcctgagagccgaggacacggctgtgtattactgtaccagagataactatggcc gcaactatgattatggcatggattattggggccagggcaccctggtgaccgtgagcagcgcctccaccaagggccca tcggtcttccccctggcgccctgctccaggagcacctccgagagcacagccgccctgggctgcctggtcaaggacta cttccccgaaccggtgacggtgtcgtggaactcaggcgctctgaccagcggcgtgcacaccttcccagctgtcctac agtcctcaggactctactccctcagcagcgtggtgaccgtgccctccagcaacttcggcacccagacctacacctgc aacgtagatcacaagcccagcaacaccaaggtggacaagacagttgagcgcaaatgttgtgtcgagtgcccaccgtg cccagcaccacctgtggcaggaccgtcagtcttcctcttccccccaaaacccaaggacaccctcatgatctcccgga cccctgaggtcacgtgcgtggtggtggacgtgagccacgaagaccccgaggtccagttcaactggtacgtggacggc gtggaggtgcataatgccaagacaaagccacgggaggagcagttcaacagcacgttccgtgtggtcagcgtcctcac cgttgtgcaccaggactggctgaacggcaaggagtacaagtgcaaggtctccaacaaaggcctcccagcccccatcg agaaaaccatctccaaaaccaaagggcagccccgagaaccacaggtgtacaccctgcccccatcccgggaggagatg accaagaaccaggtcagcctgacctgcctggtcaaaggcttctaccccagcgacatcgccgtggagtgggagagcaa tgggcagccggagaacaactacaagaccacacctcccatgctggactccgacggctccttcttcctctacagcaagc tcaccgtggacaagagcaggtggcagcaggggaacgtcttctcatgctccgtgatgcatgaggctctgcacaaccac tacacgcagaagagcctctccctgtctccgggtaaatagtaagtttaaactctaga (amino acids)

(SEQ ID NO: 53)

EF*AWATMELGLRWVFLVAILEGVQCEVQLVESGGGLVKPGGSLRLSCAASGFTFSRYGMSWVRQAPGKRLEWVSTI

SGGGTYIYYPDSVKGRFTISRDNAKNTLYLQMNSLRAEDTAVYYCTRDNYGRNYDYGMDYWGQGTLVTVSSASTKGP

SVFPLAPCSRSTSESTAALGCLVKDYFPEPVTVSWNSGALTSGVHTFPAVLQSSGLYSLSSVVTVPSSNFGTQTYTC

NVDHKPSNTKVDKTVERKCCVECPPCPAPPVAGPSVFLFPPKPKDTLMISRTPEVTCVVVDVSHEDPEVQFNWYVDG

VEVHNAKTKPREEQFNSTFRVVSVLTVVHQDWLNGKEYKCKVSNKGLPAPIEKTISKTKGQPREPQVYTLPPSREEM

TKNQVSLTCLVKGFYPSDIAVEWESNGQPENNYKTTPPMLDSDGSFFLYSKLTVDKSRWQQGNVFSCSVMHEALHNH

YTQKSLSLSPGK**V*TLX

Human IgG2 heavy chain constant region sequence:
(DNA)

(SEQ ID NO: 54)

gcctccaccaagggcccatcggtcttccccctggcgccctgctccaggagcacctccgagagcacagccgccctggg ctgcctggtcaaggactacttccccgaaccggtgacggtgtcgtggaactcaggcgctctgaccagcggcgtgcaca ccttcccagctgtcctacagtcctcaggactctactccctcagcagcgtggtgaccgtgccctccagcaacttcggc acccagacctacacctgcaacgtagatcacaagcccagcaacaccaaggtggacaagacagttgagcgcaaatgttg tgtcgagtgcccaccgtgcccagcaccacctgtggcaggaccgtcagtcttcctcttccccccaaaacccaaggaca ccctcatgatctcccggacccctgaggtcacgtgcgtggtggtggacgtgagccacgaagaccccgaggtccagttc aactggtacgtggacggcgtggaggtgcataatgccaagacaaagccacgggaggagcagttcaacagcacgttccg tgtggtcagcgtcctcaccgttgtgcaccaggactggctgaacggcaaggagtacaagtgcaaggtctccaacaaag gcctcccagcccccatcgagaaaaccatctccaaaaccaaagggcagccccgagaaccacaggtgtacaccctgccc -continued ccatcccgggaggagatgaccaagaaccaggtcagcctgacctgcctggtcaaaggcttctaccccagcgacatcgc cgtggagtgggagagcaatgggcagccggagaacaactacaagaccacacctcccatgctggactccgacggctcct tcttcctctacagcaagctcaccgtggacaagagcaggtggcagcaggggaacgtcttctcatgctccgtgatgcat gaggctctgcacaaccactacacgcagaagagcctctccctgtctccgggtaaatag (amino acids)

(SEQ ID NO: 55)
ASTKGPSVFPLAPCSRSTSESTAALGCLVKDYFPEPVTVSWNSGALTSGVHTFPAVLQSSGLYSLSSVVTVPSSNFG

TQTYTCNVDHKPSNTKVDKTVERKCCVECPPCPAPPVAGPSVFLFPPKPKDTLMISRTPEVTCVVVDVSHEDPEVQF

NWYVDGVEVHNAKTKPREEQFNSTFRVVSVLTVVHQDWLNGKEYKCKVSNKGLPAPIEKTISKTKGQPREPQVYTLP

PSREEMTKNQVSLTCLVKGFYPSDIAVEWESNGQPENNYKTTPPMLDSDGSFFLYSKLTVDKSRWQQGNVFSCSVMH

EALHNHYTQKSLSLSPGK

HumanizedE6 IgG1 heavy chain sequence:
(DNA)

(SEQ ID NO: 56)
gaggtgcagctggtggagtctggggggaggcctggtcaagcctggggggtccctgagactctcctgtgcagcctctgg attcaccttcagtaggtatggcatgagctgggtccgccaggctccagggaagaggctggagtgggtctcaaccatta gtggcggaggcacctacatatactacccagactcagtgaaggccgattcaccatctccagagacaacgccaagaac ccactgtatctgcaaatgaacagcctgagagccgaggacacggctgtgtattactgtcccagagataactatggccg caactatgattatggcatggattattggggccagggcaccctggtgaccgtgagcagcgctagcaccaagggcccat cggtcttccccctggcaccctcctccaagagcacctctgggggcacagcggccctgggctgcctggtcaaggactac ttccccgaaccggtgacggtgtcgtggaactcaggcgccctgaccagcggcgtgcacaccttcccggctgtcctaca gtcctcaggactctactccctcagcagcgtggtgacagtgccctccagcagcttgggcacccagacctacatctgca acgtgaatcacaagcccagcaacaccaaggtggacaagaaagttgagcccaaatcttgtgacaaaactcacacatgc ccaccgtgcccagcacctgaactcctggggggaccgtcagtcttcctcttccccccaaaacccaaggacaccctcat gatctcccggacccctgaggtcacatgcgtggtggtggacgtgagccacgaagaccctgaggtcaagttcaactggt acgtggacggcgtggaggtgcataatgccaagacaaagccgcgggaggagcagtacaacagcacgtaccgtgtggtc agcgtcctcaccgtcctgcaccaggactggctgaatggcaaggagtacaagtgcaaggtctccaacaaagccctccc agcccccatcgagaaaaccatctccaaagccaaagggcagccccgagaaccacaggtgtacaccctgcccccatccc gggaggagatgaccaagaaccaggtcagcctgacctgcctggtcaaaggcttctatcccagcgacatcgccgtggag tgggagagcaatgggcagccggagaacaactacaagaccacgcctcccgtgctggactccgacggctccttcttcct ctacagcaagctcaccgtggacaagagcaggtggcagcaggggaacgtcttctcatgctccgtgatgcatgaggctc tgcacaaccactacacgcagaagagcctctccctgtctccgggtaaatgataa (amino acids)

(SEQ ID NO: 57)
EVQLVESGGGLVKPGGSLRLSCAASGFTFSRYGMSWVRQAPGKRLEWVSTISGGGTYIYYPDSVKGRFTISRDNAKN

PLYLQMNSLRAEDTAVYYCPRDNYGRNYDYGMDYWGQGTLVTVSSASTKGPSVFPLAPSSKSTSGGTAALGCLVKDY

FPEPVTVSWNSGALTSGVHTFPAVLQSSGLYSLSSVVTVPSSSLGTQTYICNVNHKPSNTKVDKKVEPKSCDKTHTC

PPCPAPELLGGPSVFLFPPKPKDTLMISRTPEVTCVVVDVSHEDPEVKFNWYVDGVEVHNAKTKPREEQYNSTYRVV

SVLTVLHQDWLNGKEYKCKVSNKALPAPIEKTISKAKGQPREPQVYTLPPSREEMTKNQVSLTCLVKGFYPSDIAVE

WESNGQPENNYKTTPPVLDSDGSFFLYSKLTVDKSRWQQGNVFSCSVMHEALHNHYTQKSLSLSPGK**

Human IgG1 heavy chain constant region sequence:
(DNA)

(SEQ ID NO: 58)
gctagcaccaagggcccatcggtcttccccctggcaccctcctccaagagcacctctgggggcacagcggccctggg ctgcctggtcaaggactacttccccgaaccggtgacggtgtcgtggaactcaggcgccctgaccagcggcgtgcaca -continued cctttcccggctgtcctacagtcctcaggactctactccctcagcagcgtggtgacagtgccctccagcagcttgggc acccagacctacatctgcaacgtgaatcacaagcccagcaacaccaaggtggacaagaaagttgagcccaaatcttg tgacaaaactcacacatgcccaccgtgcccagcacctgaactcctggggggaccgtcagtcttcctcttccccccaa aacccaaggacaccctcatgatctcccggacccctgaggtcacatgcgtggtggtggacgtgagccacgaagaccct gaggtcaagttcaactggtacgtggacggcgtggaggtgcataatgccaagacaaagccgcgggaggagcagtacaa cagcacgtaccgtgtggtcagcgtcctcaccgtcctgcaccaggactggctgaatggcaaggagtacaagtgcaagg tctccaacaaagccctcccagcccccatcgagaaaaccatctccaaagccaaagggcagccccgagaaccacaggtg tacaccctgcccccatcccgggaggagatgaccaagaaccaggtcagcctgacctgcctggtcaaaggcttctatcc cagcgacatcgccgtggagtgggagagcaatgggcagccggagaacaactacaagaccacgcctcccgtgctggact ccgacggctccttcttcctctacagcaagctcaccgtggacaagagcaggtggcagcaggggaacgtcttctcatgc tccgtgatgcatgaggctctgcacaaccactacacgcagaagagcctctccctgtctccgggtaaatgataa (amino acids)
                                                                                                   (SEQ ID NO: 59)
ASTKGPSVFPLAPSSKSTSGGTAALGCLVKDYFPEPVTVSWNSGALTSGVHTFPAVLQSSGLYSLSSVVTVPSSSLG

TQTYICNVNHKPSNTKVDKKVEPKSCDKTHTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQGNVFSC

SVMHEALHNHYTQKSLSLSPGK**

Mouse E6 Light Chain variable region sequence:
(DNA)
                                                                                                   (SEQ ID NO: 65)
caaattgttctcacccagtctccagcaatcatgtctgcatctccaggggaggaggtcaccctaacctgcagtgccac ctcaagtgtaagttacatacactggttccagcagaggccaggcacttctcccaaactctggatttatagcacatcca acctggcttctggagtccctgttcgcttcagtggcagtggatatgggacctcttactctctcacaatcagccgaatg gaggctgaagatgctgccacttattactgccagcaaaggagtagttccccattcacgttcggctcggggacaaagtt ggaaataaaa (amino acids)
                                                                                                   (SEQ ID NO: 66)
QIVLTQSPAIMSASPGEEVTLTCSATSSVSYIHWFQQRPGTSPKLWIYSTSNLASGVPVRFSGSGYGTSYSLTISRM
EAEDAATYYCQQRSSSPFTFGSGTKLEIK Mouse E6 light chain variable framework region 1 (FWR1) sequence:
(DNA)
                                                                                                   (SEQ ID NO: 67)
caaattgttctcacccagtctccagcaatcatgtctgcatctccaggggaggaggtcaccctaacctgc (amino acids)
                                                                                                   (SEQ ID NO: 68)
QIVLTQSPAIMSASPGEEVTLTC Mouse E6 light chain variable complementarity determining regions 1 (CDR1)
sequence:
(DNA)
                                                                                                   (SEQ ID NO: 69)
AGTGCCACCTCAAGTGTAAGTTACATACAC (amino acids)
                                                                                                   (SEQ ID NO: 70)
SATSSVSYIH Mouse E6 light chain variable framework region 2 (FWR2) sequence:
(DNA)
                                                                                                   (SEQ ID NO: 71)
tggttccagcagaggccaggcacttctcccaaactctggatttat (amino acids)
                                                                                                   (SEQ ID NO: 72)
WFQQRPGTSPKLWIY -continued Mouse E6 light chain variable complementarity determining regions 2 (CDR2)
sequence:
(DNA)

(SEQ ID NO: 73)

agcacatccaacctggcttct (amino acids)

(SEQ ID NO: 74)

STSNLAS

Mouse E6 light chain variable framework region 3 (FWR3) sequence:
(DNA)

(SEQ ID NO: 75)

ggagtccctgttcgcttcagtggcagtggatatgggacctcttactctctcacaatcagccgaatggaggctgaaga
tgctgccacttattactgc (amino acids)

(SEQ ID NO: 76)

GVPVRFSGSGYGTSYSLTISRMEAEDAATYYC

Mouse E6 light chain variable complementarity determining regions 3 (CDR3)
sequence:
(DNA)

(SEQ ID NO: 77)

cagcaaaggagtagttcccattcacg (amino acids)

(SEQ ID NO: 78)

QQRSSSPFT

Humanized E6 light chain variable region sequence from IGKV3-11*02:
(DNA)

(SEQ ID NO: 93)

gaaattgtgttgacacagtctccagccaccctgtctttgtctccaggggaaagagccaccctcacctgcagcgccac cagcagtgttagctacatccactggtaccaacagaggcctggccagagccccaggctcctcatctatagcacctcca acctggccagcggcatcccagccaggttcagtggcagtgggtctgggagcgactacactctcaccatcagcagccta gagcctgaagattttgcagtttattactgtcagcagcgtagcagctccccttttcacctttggcagcggcaccaaagt ggaaattaaa (amino acids)

(SEQ ID NO: 94)

EIVLTQSPATLSLSPGERATLTCSATSSVSYIHWYQQRPGQSPRLLIYSTSNLASGIPARFSGSGSGSDYTLTISSL

EPEDFAVYYCQQRSSSPFTFGSGTKVEIK

Humanized E6 light chain variable framework region 1 (FWR1) acid sequence:
(DNA)

(SEQ ID NO: 95)

gaaattgtgttgacacagtctccagccaccctgtctttgtctccaggggaaagagccaccctcacctgc (amino acids)

(SEQ ID NO: 96)

EIVLTQSPATLSLSPGERATLTC

Humanized E6 light chain variable complementarity determining regions 1 (CDR1)
sequence:
(DNA)

(SEQ ID NO: 97)

agcgccaccagcagtgttagctacatccac (amino acids)

(SEQ ID NO: 98)

SATSSVSYIH

Humanized E6 heavy light variable framework region 2 (FWR2) acid sequence:
(DNA)

(SEQ ID NO: 99)

tggtaccaacagaggcctggccagagccccaggctcctcatctat (amino acids)

(SEQ ID NO: 100)

WYQQRPGQSPRLLIY

-continued

Humanized E6 light chain variable complementarity determining regions 2
(CDR2) sequence:
(DNA)

(SEQ ID NO: 101)

agcacctccaacctggccagc (amino acids)

(SEQ ID NO: 102)

STSNLAS

Humanized E6 light chain variable framework region 3 (FWR3) acid sequence:
(DNA)

(SEQ ID NO: 103)

ggcatcccagccaggttcagtggcagtgggtctgggagcgactacactctcaccatcagcagcctagagcctgaaga ttttgcagtttattactgt (amino acids)

(SEQ ID NO: 104)

GIPARFSGSGSGSDYTLTISSLEPEDFAVYYC

Humanized E6 light chain variable complementarity determining regions 3
(CDR3) sequence:
(DNA)

(SEQ ID NO: 105)

cagcagcgtagcagctccccttcacc (amino acids)

(SEQ ID NO: 106)

QQRSSSPFT

Humanized E6 Kappa light chain synthesized by Genescript:
(DNA)

(SEQ ID NO: 107)

gaattctaagcttgggccaccatggaagccccagcgcagcttctcttcctcctgctactctggctcccagataccac tggagaaattgtgttgacacagtctccagccaccctgtctttgtctccaggggaaagagccaccctcacctgcagcg ccaccagcagtgttagctacatccactggtaccaacagaggcctggccagagcccccaggctcctcatctatagcacc tccaacctggccagcggcatcccagccaggttcagtggcagtgggtctgggagcgactacactctcaccatcagcag cctagagcctgaagattttgcagtttattactgtcagcagcgtagcagctcccctttcacctttggcagcggcacca aagtggaaattaaaaggacggtggctgcaccatctgtcttcatcttcccgccatctgatgagcagttgaaatctgga actgcctctgttgtgtgcctgctgaataacttctatcccagagaggccaaagtacagtggaaggtggataacgccct ccaatcgggtaactcccaggagagtgtcacagagcaggacagcaaggacagcacctacagcctcagcagcaccctga cgctgagcaaagcagactacgagaaacacaaagtctacgcctgcgaagtcacccatcagggcctgagctcgcccgtc acaaagagcttcaacaggggagagtgttagtaagtttaaactctaga (amino acids)

(SEQ ID NO: 108)

EF*AWATMEAPAQLLELLLLWLPDTTGEIVLTQSPATLSLSPGERATLTCSATSSVSYIHWYQQRPGQSPRLLIYST

SNLASGIPARFSGSGSGSDYTLTISSLEPEDFAVYYCQQRSSSPFTFGSGTKVEIKRTVAAPSVFIFPPSDEQLKSG

TASVVCLLNNEYPREAKVQWKVDNALQSGNSQESVTEQDSKDSTYSLSSTLTLSKADYEKHKVYACEVTHQGLSSPV

TKSENRGEC**V*TLX

Human Kappa light chain constant region sequence:
(DNA)

(SEQ ID NO: 109)

aggacggtggctgcaccatctgtcttcatcttcccgccatctgatgagcagttgaaatctggaactgcctctgttgt gtgcctgctgaataacttctatcccagagaggccaaagtacagtggaaggtggataacgccctccaatcgggtaact cccaggagagtgtcacagagcaggacagcaaggacagcacctacagcctcagcagcaccctgacgctgagcaaagca gactacgagaaacacaaagtctacgcctgcgaagtcacccatcagggcctgagctcgcccgtcacaaagagcttcaa cagggggagagtgttag -continued (amino acids)

(SEQ ID NO: 110)

RTVAAPSVFIFPPSDEQLKSGTASVVCLLNNEYPREAKVQWKVDNALQSGNSQESVTEQDSKDSTYSLSSTLTLSKA

DYEKHKVYACEVTHQGLSSPVTKSFNRGEC

Humanized E6 lambda light chain sequence:
(DNA)

(SEQ ID NO: 111)

gaaattgtgttgacacagtctccagccaccctgtctttgtctccaggggaaagagccaccctcacctgcagcgccac cagcagtgttagctacatccactggtaccaacagaggcctggccagagccccaggctcctcatctatagcacctcca acctggccagcggcatcccagccaggttcagtggcagtgggtctgggagcgactacactctcaccatcagcagccta gagcctgaagattttgcagtttattactgtcagcagcgtagcagctcccctttcacctttggcagcggcaccaaagt ggaaattaaaggtcagcccaaggctgcccctcggtcactctgttcccgccctcctctgaggagcttcaagccaaca aggccacactggtgtgtctcataagtgacttctacccgggagccgtgacagtggcctggaaggcagatagcagcccc gtcaaggcgggagtggagaccaccacaccctccaaacaaagcaacaacaagtacgcggccagcagctatctgagcct gacgcctgagcagtggaagtcccacagaagctacagctgccaggtcacgcatgaagggagcaccgtggagaagacag tggcccctacagaatgttcatagtaa (amino acids)
(SEQ ID NO: 112)

EIVLTQSPATLSLSPGERATLTCSATSSVSYIHWYQQRPGQSPRLLIYSTSNLASGIPARFSGSGSGSDYTLTISSL

EPEDFAVYYCQQRSSSPFTEGSGTKVEIKGQPKAAPSVTLEPPSSEELQANKATLVCLISDFYPGAVTVAWKADSSP

VKAGVETTTPSKQSNNKYAASSYLSLTPEQWKSHRSYSCQVTHEGSTVEKTVAPTECS**

Humanized lambda light chain constant region sequence:
(DNA)

(SEQ ID NO: 113)

ggtcagcccaaggctgcccctcggtcactctgttcccgccctcctctgaggagcttcaagccaacaaggccacact ggtgtgtctcataagtgacttctacccgggagccgtgacagtggcctggaaggcagatagcagccccgtcaaggcgg gagtggagaccaccacaccctccaaacaaagcaacaacaagtacgcggccagcagctatctgagcctgacgcctgag cagtggaagtcccacagaagctacagctgccaggtcacgcatgaagggagcaccgtggagaagacagtggcccctac agaatgttcatagtaa (amino acids)

(SEQ ID NO: 114)

GQPKAAPSVTLEPPSSEELQANKATLVCLISDFYPGAVTVAWKADSSPVKAGVETTTPSKQSNNKYAASSYLSLTPE

QWKSHRSYSCQVTHEGSTVEKTVAPTECS**

Mouse C2 heavy chain variable region sequence:
(DNA)

(SEQ ID NO: 118)

gaggtccagctggaggagtcagggggaggcttagtgaagcctggagggtccctgaaactctcctgtgcagcctctgg attcactttcagtggctatgccatgtcttgggttcgccagactccggagaagaggctggagtgggtcgcaaccatta gtagtggtggtacttatatctactatccagacagtgtgaaggggcgattcaccatctccagagacaatgccaagaac accctgtacctgcaaatgagcagtctgaggtctgaggacacggccatgtattactgtgcaagacttgggggggataa ttactacgaatacttcgatgtctggggcgcagggaccacggtcaccgtctcctccgccaaaacgacacccccatctg tctat (amino acids)

(SEQ ID NO: 119)

EVQLEESGGGLVKPGGSLKLSCAASGFTFSGYAMSWVRQTPEKRLEWVATISSGGTYIYYPDSVKGRFTISRDNAKN

TLYLQMSSLRSEDTAMYYCARLGGDNYYEYFDVWGAGTTVTVSSAKTTPPSVY

-continued

Mouse C2 heavy chain variable framework region 1 (FWR1) sequence:
(DNA)

(SEQ ID NO: 120)

gaggtccagctggaggagtcaggggggaggcttagtgaagcctggagggtccctgaaactctcctgtgcagcctctgg attcactttcagt (amino acids)

(SEQ ID NO: 121)

EVQLEESGGGLVKPGGSLKLSCAASGFTFS

Mouse C2 heavy chain variable complementarity determining regions 1 (CDR1)
sequence:
(DNA)

(SEQ ID NO: 122)

ggctatgccatgtct (amino acids)

(SEQ ID NO: 123)

GYAMS

Mouse C2 heavy chain variable framework region 2 (FWR2) sequence:
(DNA)

(SEQ ID NO: 124)

tgggttcgccagactccggagaagaggctggagtgggtcgca (amino acids)

(SEQ ID NO: 125)

WVRQTPEKRLEWVA

Mouse C2 heavy chain variable complementarity determining regions 2 (CDR2)
sequence:
(DNA)

(SEQ ID NO: 126)

accattagtagtggtggtacttatatctactatccagacagtgtgaagggg (amino acids)

(SEQ ID NO: 127)

TISSGGTYIYYPDSVKG

Mouse C2 heavy chain variable framework region 3 (FWR3) sequence:
(DNA)

(SEQ ID NO: 128)

cgattcaccatctccagagacaatgccaagaacaccctgtacctgcaaatgagcagtctgaggtctgaggacacggc catgtattactgtgcaaga (amino acids)

(SEQ ID NO: 129)

RFTISRDNAKNTLYLQMSSLRSEDTAMYYCAR

Mouse C2 heavy chain variable complementarity determining regions 3 (CDR3)
sequence:
(DNA)

(SEQ ID NO: 130)

cttggggggggataattactacgaatacttcgatgtc (amino acids)

(SEQ ID NO: 131)

LGGDNYYEYFDV

Humanized derived from IGHV3-21*04:
Humanized C2 heavy chain variable region sequence:
(DNA)

(SEQ ID NO: 144)

gaggtgcagctggtggagtctgggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttggggggggataa ttactacgaatacttcgatgtctggggcaaagggaccacggtcaccgtctcctcc (amino acids)

(SEQ ID NO: 145)

EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSS

-continued

Humanized C2 heavy chain variable framework region 1 (FWR1) sequence:
(DNA)

(SEQ ID NO: 146)

gaggtgcagctggtggagtctggggggaggcctggtcaagcctggggggtccctgagactctcctgtgcagcctctgg attcaccttcagt
(amino acids)

(SEQ ID NO: 147)

EVQLVESGGGLVKPGGSLRLSCAASGFTFS

Humanized C2 heavy chain variable complementarity determining regions 1 (CDR1)
sequence:
(DNA)

(SEQ ID NO: 148)

ggctatgccatgagc (amino acids)

(SEQ ID NO: 149)

GYAMS

Humanized C2 heavy chain variable framework region 2 (FWR2) sequence:
(DNA)

(SEQ ID NO: 150)

tgggtccgccaggctccagggaaggggctggagtgggtctcaa (amino acids)

(SEQ ID NO: 151)

WVRQAPGKGLEWVS

Humanized C2 heavy chain variable complementarity determiningregions 2
(CDR2) sequence:
(DNA)

(SEQ ID NO: 152)

accattagtagtggcggaacctacatatactaccccgactcagtgaagggc (amino acids)

(SEQ ID NO: 153)

TISSGGTYIYYPDSVKG

Humanized C2 heavy chain variable framework region 3 (FWR3) sequence:
(DNA)

(SEQ ID NO: 154)

cgattcaccatctccagagacaacgccaagaactcactgtatctgcaaatgaacagcctgagagccgaggacacggc cgtgtattactgtgcgaga (amino acids)

(SEQ ID NO: 155)

RFTISRDNAKNSLYLQMNSLRAEDTAVYYCAR

Humanized C2 heavy chain variable complementarity determining regions 3
(CDR3) sequence:
(DNA)

(SEQ ID NO: 156)

cttggggggggataattactacgaatacttcgatgtc (amino acids)

(SEQ ID NO: 157)

LGGDNYYEYFDV

Humanized C2 IgG1 heavy chain sequence
(DNA)

(SEQ ID NO: 157)

gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttggggggggataa ttactacgaatacttcgatgtctggggcaaagggaccacggtcaccgtctcctccgctagcaccaagggcccatcgg tcttccccctggcaccctcctccaagagcacctctgggggcacagcggccctgggctgcctggtcaaggactacttc cccgaaccggtgacggtgtcgtggaactcaggcgccctgaccagcggcgtgcacaccttcccggctgtcctacagtc ctcaggactctactccctcagcagcgtggtgacagtgccctccagcagcttgggcacccagacctacatctgcaacg tgaatcacaagcccagcaacaccaaggtggacaagaaagttgagcccaaatcttgtgacaaaactcacacatgccca -continued ccgtgcccagcacctgaactcctggggggaccgtcagtcttcctcttccccccaaaacccaaggacaccctcatgat ctcccggacccctgaggtcacatgcgtggtggtggacgtgagccacgaagaccctgaggtcaagttcaactggtacg tggacggcgtggaggtgcataatgccaagacaaagccgcgggaggagcagtacaacagcacgtaccgtgtggtcagc gtcctcaccgtcctgcaccaggactggctgaatggcaaggagtacaagtgcaaggtctccaacaaagccctcccagc ccccatcgagaaaaccatctccaaagccaaagggcagccccgagaaccacaggtgtacaccctgcccccatcccggg aggagatgaccaagaaccaggtcagcctgacctgcctggtcaaaggcttctatcccagcgacatcgccgtggagtgg gagagcaatgggcagccggagaacaactacaagaccacgcctcccgtgctggactccgacggctccttcttcctcta cagcaagctcaccgtggacaagagcaggtggcagcaggggaacgtcttctcatgctccgtgatgcatgaggctctgc acaaccactacacgcagaagagcctctccctgtctccgggtaaatgataa (amino acids)

(SEQ ID NO: 158)

EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSASTKGPSVFPLAPSSKSTSGGTAALGCLVKDYF

PEPVTVSWNSGALTSGVHTFPAVLQSSGLYSLSSVVTVPSSSLGTQTYICNVNHKPSNTKVDKKVEPKSCDKTHTCP

PCPAPELLGGPSVFLEPPKPKDTLMISRTPEVTCVVVDVSHEDPEVKFNWYVDGVEVHNAKTKPREEQYNSTYRVVS

VLTVLHQDWLNGKEYKCKVSNKALPAPIEKTISKAKGQPREPQVYTLPPSREEMTKNQVSLTCLVKGFYPSDIAVEW

ESNGQPENNYKTTPPVLDSDGSFFLYSKLTVDKSRWQQGNVESCSVMHEALHNHYTQKSLSLSPGK**

Humanized C2 IgG2 heavy chain sequence
(DNA)

(SEQ ID NO: 163)

gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttgggggggataa ttactacgaatacttcgatgtctggggcaaagggaccacggtcaccgtctcctccgcctccaccaagggcccatcgg tcttccccctggcgccctgctccaggagcacctccgagagcacagccgccctgggctgcctggtcaaggactacttc cccgaaccggtgacggtgtcgtggaactcaggcgctctgaccagcggcgtgcacaccttcccagctgtcctacagtc ctcaggactctactccctcagcagcgtggtgaccgtgccctccagcaacttcggcacccagacctacacctgcaacg tagatcacaagcccagcaacaccaaggtggacaagacagttgagcgcaaatgttgtgtcgagtgcccaccgtgccca gcaccacctgtggcaggaccgtcagtcttcctcttccccccaaaacccaaggacaccctcatgatctcccggacccc tgaggtcacgtgcgtggtggtggacgtgagccacgaagaccccgaggtccagttcaactggtacgtggacggcgtgg aggtgcataatgccaagacaaagccacgggaggagcagttcaacagcacgttccgtgtggtcagcgtcctcaccgtt gtgcaccaggactggctgaacggcaaggagtacaagtgcaaggtctccaacaaaggcctcccagcccccatcgagaa aaccatctccaaaaccaaagggcagccccgagaaccacaggtgtacaccctgcccccatcccgggaggagatgacca gaaccaggtcagcctgacctgcctggtcaaaggcttctaccccagcgacatcgccgtggagtgggagagcaatggg cagccggagaacaactacaagaccacacctcccatgctggactccgacggctccttcttcctctacagcaagctcac cgtggacaagagcaggtggcagcaggggaacgtcttctcatgctccgtgatgcatgaggctctgcacaaccactaca cgcagaagagcctctccctgtctccgggtaaatagtaa (amino acids)

(SEQ ID NO: 164)

EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSASTKGPSVFPLAPCSRSTSESTAALGCLVKDYF

PEPVTVSWNSGALTSGVHTFPAVLQSSGLYSLSSVVTVPSSNFGTQTYTCNVDHKPSNTKVDKTVERKCCVECPPCP

APPVAGPSVFLEPPKPKDTLMISRTPEVTCVVVDVSHEDPEVQFNWYVDGVEVHNAKTKPREEQFNSTFRVVSVLTV

VHQDWLNGKEYKCKVSNKGLPAPIEKTISKTKGQPREPQVYTLPPSREEMTKNQVSLTCLVKGFYPSDIAVEWESNG

QPENNYKTTPPMLDSDGSFFLYSKLTVDKSRWQQGNVESCSVMHEALHNHYTQKSLSLSPGK**

Mouse C2 light chain variable region sequence:
(DNA)

(SEQ ID NO: 168)

gacattgtgatcacacagtctacagcttccttaggtgtatctctggggcagagggccaccatctcatgcagggccag caaaagtgtcagtacatctggctatagttatatgcactggtaccaacagagaccaggacagccacccaaactcctca tctatcttgcatccaacctagaatctggggtccctgccaggttcagtggcagtgggtctgggacagacttcaccctc aacatccatcctgtggaggaggaggatgctgcaacctattactgtcagcacagtagggagcttccgttcacgttcgg aggggggaccaagctggagataaaacgggctgatgctgcaccaactgtatcc (amino acids)

(SEQ ID NO: 169)

DIVITQSTASLGVSLGQRATISCRASKSVSTSGYSYMHWYQQRPGQPPKLLIYLASNLESGVPARFSGSGSGTDFTL

NIHPVEEEDAATYYCQHSRELPFTFGGGTKLEIKRADAAPTVS

Mouse C2 light chain variable framework region 1 (FWR1) sequence:
(DNA)

(SEQ ID NO: 170)

gacattgtgatcacacagtctacagcttccttaggtgtatctctggggcagagggccaccatctcatgc (amino acids)

(SEQ ID NO: 171)

DIVITQSTASLGVSLGQRATISC

Mouse C2 light chain variable complementarity determining regions 1 (CDR1)
sequence:
(DNA)

(SEQ ID NO: 172)

agggccagcaaaagtgtcagtacatctggctatagttatatgcac (amino acids)

(SEQ ID NO: 173)

RASKSVSTSGYSYMH

Mouse C2 light chain variable framework region 2 (FWR2) sequence:
(DNA)

(SEQ ID NO: 174)

tggtaccaacagagaccaggacagccacccaaactcctcatctat (amino acids)

(SEQ ID NO: 175)

WYQQRPGQPPKLLIY

Mouse C2 light chain variable complementarity determining regions 2 (CDR2)
sequence:
(DNA)

(SEQ ID NO: 176)

cttgcatccaacctagaatc (amino acids)

(SEQ ID NO: 177)

LASNLES

Mouse C2 light chain variable framework region 3 (FWR3) sequence:
(DNA)

(SEQ ID NO: 178)

tggggtccctgccaggttcagtggcagtgggtctgggacagacttcaccctcaacatccatcctgtggaggaggagg atgctgcaacctattactgt (amino acids)

(SEQ ID NO: 179)

GVPARFSGSGSGTDFTLNIHPVEEEDAATYYC

Mouse C2 light chain variable complementarity determining regions 3 (CDR3)
sequence:
(DNA)

(SEQ ID NO: 180)

cagcacagtagggagcttccgttcacg (amino acids)

(SEQ ID NO: 181)

QHSRELPFT

-continued

Humanized derived from IGKV7-3*01
Humanized C2 light chain variable region sequence:
(DNA)
(SEQ ID NO: 194)
gacattgtgctgacccagtctccagcctccttggccgtgtctccaggacagagggccaccatcacctgcagagccag taagagtgtcagtaccagcggatactcctacatgcactggtatcagcagaaaccaggacaacctcctaaactcctga tttacctggcatccaatctggagagcggggtcccagccaggttcagcggcagtgggtctgggaccgatttcaccctc acaattaatcctgtggaagctaatgatactgcaaattattactgtcagcacagtagggagctgcctttcacattcgg cggagggaccaaggtggagatcaaacgaact (amino acids)
(SEQ ID NO: 195)
DIVLTQSPASLAVSPGQRATITCRASKSVSTSGYSYMHWYQQKPGQPPKLLIYLASNLESGVPARFSGSGSGTDFTL
TINPVEANDTANYYCQHSRELPFTFGGGTKVEIKRT Humanized C2 light chain variable framework region 1 (FWR1) acid sequence:
(DNA)
(SEQ ID NO: 196)
gacattgtgctgacccagtctccagcctccttggccgtgtctccaggacagagggccaccatcacctgc (amino acids)
(SEQ ID NO: 197)
DIVLTQSPASLAVSPGQRATITC Humanized C2 light chain variable complementarity determining regions 1 (CDR1)
sequence:
(DNA)
(SEQ ID NO: 198)
agagccagtaagagtgtcagtaccagcggatactcctacatgcac (amino acids)
(SEQ ID NO: 199)
RASKSVSTSGYSYMH
Humanized C2 heavy light variable framework region 2 (FWR2) acid sequence:

(DNA)
(SEQ ID NO: 200)
tggtatcagcagaaaccaggacaacctcctaaactcctgatttac
(amino acids)

(SEQ ID NO: 201)
WYQQKPGQPPKLLIY

Humanized C2 light chain variable complementarity determining regions 2
(CDR2) sequence:
(DNA)
(SEQ ID NO: 202)
ctggcatccaatctggagagc
(amino acids)

(SEQ ID NO: 203)
LASNLES

Humanized C2 light chain variable framework region 3 (FWR3) acid sequence:
(DNA)
(SEQ ID NO: 204)
ggggtcccagccaggttcagcggcagtgggtctgggaccgatttcaccctcacaattaatcctgtggaagctaatga tactgcaaattattactgt (amino acids)
(SEQ ID NO: 205)
GVPARFSGSGSGTDFTLTINPVEANDTANYYC Humanized C2 light chain variable complementarity determining regions 3
(CDR3) sequence:
(DNA)
(SEQ ID NO: 206)
cagcacagtagggagctgcctttcaca (amino acids)
(SEQ ID NO: 207)
QHSRELPFT -continued Humanized C2 light chain variable complementarity determining regions 3
(CDR3) sequence:
(DNA)
                                                              (SEQ ID NO: 208)
ctgcagagtaagaattttcctcccaca (amino acids)
                                                              (SEQ ID NO: 209)
LQSKNFPPT Murine Ig kappa chain leader sequence
(DNA)
                                                              (SEQ ID NO: 222)
atggagacagacacactcctgctatgggtactgctgctctgggttccaggttccactggtgac (amino acids)
                                                              (SEQ ID NO: 223)
METDTLLLWVLLLWVPGSTGD Interleukin-2 (IL-2) leader sequence
(DNA)
                                                              (SEQ ID NO: 224)
atgtacaggatgcaactcctgtcttgcattgcactaagtcttgcacttgtcacaaacagt (amino acids)
                                                              (SEQ ID NO: 225)
MYRMQLLSCIALSLALVTNS CD33 leader sequence
(DNA)
                                                              (SEQ ID NO: 226)
atgcctcttctgcttctgcttcctctgctttgggctggagctcttgct (amino acids)
                                                              (SEQ ID NO: 227)
MPLLLLLPLLWAGALA IGHV3-21*03 leader sequence
(DNA)
                                                              (SEQ ID NO: 228)
atggaactggggctccgctgggttttccttgttgctatttttagaaggtgtccagtgt (amino acids)
                                                              (SEQ ID NO: 229)
MELGLRWVFLVAILEGVQC IGHV3-11*02 leader sequence
(DNA)
                                                              (SEQ ID NO: 230)
atggaagcccccagcgcagcttctcttcctcctgctactctggctcccagataccactgga (amino acids)
                                                              (SEQ ID NO: 231)
MEAPAQLLFLLLLWLPDTTG Humanized E6 single chain GS3
(DNA)
                                                              (SEQ ID NO: 232)
gaggtgcagctggtggagtctgggggaggcctggtcaagcctggggggtccctgagactctcctgtgcagcctctgg attcaccttcagtaggtatggcatgagctgggtccgccaggctccagggaagaggctggagtgggtctcaaccatta gtggcggaggcacctacatatactacccagactcagtgaagggccgattcaccatctccagagacaacgccaagaac accctgtatctgcaaatgaacagcctgagagccgaggacacggctgtgtattactgtaccagagataactatggccg caactatgattatggcatggattattggggccagggcaccctggtgaccgtgagcagcggcggtggcggatccggcg gtggcggatccggcggtggcggatccgaaattgtgttgacacagtctccagccaccctgtctttgtctccagggggaa agagccaccctcacctgcagcgccaccagcagtgttagctacatccactggtaccaacagaggcctggccagagccc caggctcctcatctatagcacctccaacctggccagcggcatcccagccaggttcagtggcagtgggtctgggagcg actacactctcaccatcagcagcctagagcctgaagattttgcagtttattactgtcagcagcgtagcagctcccct ttcacctttggcagcggcaccaaagtggaaattaaa (amino acids)

(SEQ ID NO: 233)

EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSSGGGGSGGGGSGGGGSEIVLTQSPATLSLSPGE

RATLTCSATSSVSYIHWYQQRPGQSPRLLIYSTSNLASGIPARFSGSGSGSDYTLTISSLEPEDFAVYYCQQRSSSP

FTFGSGTKVEIK

Humanized E6 single chain IgGlnoC
(DNA)

(SEQ ID NO: 234)

gaggtgcagctggtggagtctggggggaggcctggtcaagcctggggggtccctgagactctcctgtgcagcctctgg attcaccttcagtaggtatggcatgagctgggtccgccaggctccagggaagaggctggagtgggtctcaaccatta gtggcggaggcacctacatatactacccagactcagtgaagggccgattcaccatctccagagacaacgccaagaac accctgtatctgcaaatgaacagcctgagagccgaggacacggctgtgtattactgtaccagagataactatggccg caactatgattatggcatggattattggggccagggcaccctggtgaccgtgagcagcgataaaacccatactaaac cgccaaaaccggcgccggaactgctgggtggtcctggtaccggtgaaattgtgttgacacagtctccagccaccctg tctttgtctccaggggaaagagccaccctcacctgcagcgccaccagcagtgttagctacatccactggtaccaaca gaggcctggccagagccccaggctcctcatctatagcacctccaacctggccagcggcatcccagccaggttcagtg gcagtgggtctgggagcgactacactctcaccatcagcagcctagagcctgaagattttgcagtttattactgtcag cagcgtagcagctcccctttcacctttggcagcggcaccaaagtggaaattaaa (amino acids)

(SEQ ID NO: 235)

EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSSDKTHTKPPKPAPELLGGPGTGEIVLTQSPATL

SLSPGERATLTCSATSSVSYIHWYQQRPGQSPRLLIYSTSNLASGIPARFSGSGSGSDYTLTISSLEPEDFAVYYCQ

QRSSSPFTFGSGTKVEIK

Humanized E6 single chain X4 (linker is IgG1 and IgG2 modified hinge region)
(DNA)

(SEQ ID NO: 236)

gaggtgcagctggtggagtctggggggaggcctggtcaagcctggggggtccctgagactctcctgtgcagcctctgg attcaccttcagtaggtatggcatgagctgggtccgccaggctccagggaagaggctggagtgggtctcaaccatta gtggcggaggcacctacatatactacccagactcagtgaagggccgattcaccatctccagagacaacgccaagaac accctgtatctgcaaatgaacagcctgagagccgaggacacggctgtgtattactgtaccagagataactatggccg caactatgattatggcatggattattggggccagggcaccctggtgaccgtgagcagcgataaaacccatactaaac cgccaaaaccggcgccggaactgctgggtggtcctggtaccggtactggtggtccgactattaaacctccgaaacct ccgaaacctgctccgaacctgctgggtggtccggaaattgtgttgacacagtctccagccaccctgtctttgtctcc aggggaaagagccaccctcacctgcagcgccaccagcagtgttagctacatccactggtaccaacagaggcctggcc agagccccaggctcctcatctatagcacctccaacctggccagcggcatcccagccaggttcagtggcagtgggtct gggagcgactacactctcaccatcagcagcctagagcctgaagattttgcagtttattactgtcagcagcgtagcag ctcccctttcacctttggcagcggcaccaaagtggaaattaaa (amino acids)

(SEQ ID NO: 237)

EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSSDKTHTKPPKPAPELLGGPGTGTGGPTIKPPKP

PKPAPNLLGGPEIVLTQSPATLSLSPGERATLTCSATSSVSYIHWYQQRPGQSPRLLIYSTSNLASGIPARFSGSGS

GSDYTLTISSLEPEDFAVYYCQQRSSSPFTFGSGTKVEIK

-continued

Humanized C2 single chain GS3
(DNA)

(SEQ ID NO: 238)
gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttgggggggataa ttactacgaatacttcgatgtctggggcaaagggaccacggtcaccgtctcctccggcggtggcggatccggcggtg gcggatccggcggtggcggatccgacattgtgctgacccagtctccagcctccttggccgtgtctccaggacagagg gccaccatcacctgcagagccagtaagagtgtcagtaccagcggatactcctacatgcactggtatcagcagaaacc aggacaacctcctaaactcctgatttacctggcatccaatctggagagcggggtcccagccaggttcagcggcagtg ggtctgggaccgatttcaccctcacaattaatcctgtggaagctaatgatactgcaaattattactgtcagcacagt agggagctgcctttcacattcggcggagggaccaaggtggagatcaaacgaact (amino acids)

(SEQ ID NO: 239)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSGGGGSGGGGSGGGGSDIVLTQSPASLAVSPGQR

ATITCRASKSVSTSGYSYMHWYQQKPGQPPKLLIYLASNLESGVPARFSGSGSGTDFTLTINPVEANDTANYYCQHS

RELPFTFGGGTKVEIKRT

Humanized C2 single chain X4 (linker is IgG1 and IgG2 modified hinge region)
(DNA)

(SEQ ID NO: 242)
gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttgggggggataa ttactacgaatacttcgatgtctggggcaaagggaccacggtcaccgtctcctccgataaaacccatactaaaccgc caaaaccggcgccggaactgctgggtggtcctggtaccggtactggtggtccgactattaaacctccgaaacctccg aaacctgctccgaacctgctgggtggtccggacattgtgctgacccagtctccagcctccttggccgtgtctccagg acagagggccaccatcacctgcagagccagtaagagtgtcagtaccagcggatactcctacatgcactggtatcagc agaaaccaggacaacctcctaaactcctgatttacctggcatccaatctggagagcggggtcccagccaggttcagc ggcagtgggtctgggaccgatttcaccctcacaattaatcctgtggaagctaatgatactgcaaattattactgtca gcacagtagggagctgcctttcacattcggcggagggaccaaggtggagatcaaacgaact (amino acids)

(SEQ ID NO: 243)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYEDVWGKGTTVTVSSDKTHTKPPKPAPELLGGPGTGTGGPTIKPPKPP

KPAPNLLGGPDIVLTQSPASLAVSPGQRATITCRASKSVSTSGYSYMHWYQQKPGQPPKLLIYLASNLESGVPARFS

GSGSGTDFTLTINPVEANDTANYYCQHSRELPFTEGGGTKVEIKRT

Humanized C3 single chain GS3
(DNA)

(SEQ ID NO: 244)
caggttcagctggtgcagtctggagctgaggtgaagaagcctggggcctcagtgaaggtctcctgcaaggcttctgg ttacacctttaccgactacgccatgaactgggtgcgacaggcccctggacaagggcttgagtggatgggagtgatca gcaccttcagcggtaacacaaacttcaaccagaagttcaagggcagagtcaccatgaccacagacacatccacgagc acagcctacatggagctgaggagcctgagatctgacgacacggccgtgtattactgtgcgagaagcgactactacgg cccatacttcgactactggggccagggcaccaccctgaccgtgtccagcggcggtggcggatccggcggtggcggat ccggcggtggcggatccgatattgtgatgacccagactccactctctctgtccgtcaccctggacagccggcctcc atctcctgcaggtctagtcagaccattgtccatagtaatggaaacacctatttggagtggtacctgcagaagccagg ccagtctccacagctcctgatctataaggtttccaaccggttctctggagtgccagataggttcagtggcagcgggt cagggacagatttcacactgaaaatcagccgggtggaggctgaggatgttggggtttattactgcttccaaggtagc cacgtgcctttcaccttcggcggagggaccaaggtggagatcaaacgaact (amino acids)
                                                          (SEQ ID NO: 245)
QVQLVQSGAEVKKPGASVKVSCKASGYTFTDYAMNWVRQAPGQGLEWMGVISTFSGNTNFNQKFKGRVTMTTDTSTS

TAYMELRSLRSDDTAVYYCARSDYYGPYFDYWGQGTTLTVSSGGGGSGGGGSGGGGSDIVMTQTPLSLSVTPGQPAS

ISCRSSQTIVHSNGNTYLEWYLQKPGQSPQLLIYKVSNRFSGVPDRFSGSGSGTDFTLKISRVEAEDVGVYYCFQGS

HVPFTFGGGTKVEIKRT

Humanized C3 single chain X4 (linker is IgG1 and IgG2 modified hinge region)
(DNA)
                                                          (SEQ ID NO: 248)
caggttcagctggtgcagtctggagctgaggtgaagaagcctggggcctcagtgaaggtctcctgcaaggcttctgg ttacacctttaccgactacgccatgaactgggtgcgacaggcccctggacaagggcttgagtggatgggagtgatca gcaccttcagcggtaacacaaacttcaaccagaagttcaagggcagagtcaccatgaccacagacacatccacgagc acagcctacatggagctgaggagcctgagatctgacgacacggccgtgtattactgtgcgagaagcgactactacgg cccatacttcgactactggggccagggcaccaccctgaccgtgtccagcgataaaacccatactaaaccgccaaaac cggcgccggaactgctgggtggtcctggtaccggtactggtggtccgactattaaacctccgaaacctccgaaacct gctccgaacctgctgggtggtccggatattgtgatgacccagactccactctctctgtccgtcaccctggacagcc ggcctccatctcctgcaggtctagtcagaccattgtccatagtaatggaaacacctatttggagtggtacctgcaga agccaggccagtctccacagctcctgatctataaggtttccaaccggttctctggagtgccagataggttcagtggc agcgggtcagggacagatttcacactgaaaatcagccgggtggaggctgaggatgttggggtttattactgcttcca aggtagccacgtgcctttcaccttcggcggagggaccaaggtggagatcaaacgaact (amino acids)
                                                          (SEQ ID NO: 249)
QVQLVQSGAEVKKPGASVKVSCKASGYTFTDYAMNWVRQAPGQGLEWMGVISTFSGNTNFNQKFKGRVTMTTDTSTS

TAYMELRSLRSDDTAVYYCARSDYYGPYFDYWGQGTTLTVSSDKTHTKPPKPAPELLGGPGTGTGGPTIKPPKPPKP

APNLLGGPDIVMTQTPLSLSVTPGQPASISCRSSQTIVHSNGNTYLEWYLQKPGQSPQLLIYKVSNRFSGVPDRFSG

SGSGTDFTLKISRVEAEDVGVYYCFQGSHVPFTEGGGTKVEIKRT

Humanized C8 single chain GS3 (linker is [Gly4Seri]3)
(DNA)
                                                          (SEQ ID NO: 250)
gaggtgcagctggtggagtctggggga ggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccctgactcagtgaagggccgattcaccatctccagagacaacgccaagaac tcactgtatctgcaaatgaacagcctgagagccgaggacacggccgtgtattactgtgcgagactgggcggcgataa ctattatgaatattggggcaaagggaccacggtcaccgtctcctccggcggtggcggatccggcggtggcggatccg gcggtggcggatccgacatcgtgatgacccagtctccagactccctggctgtgtctctgggcgagagggccaccatc aactgcagggccagcaagagtgttagcaccagcggctacagctacatgcactggtaccagcagaaaccaggacagcc tcctaagctgctcatttacctggtgtctaacctggaatccggggtccctgaccgattcagtggcagcgggtctggga cagatttcactctcaccatcagcagcctgcaggctgaagatgtggcagtttattactgtcaacacattcgggaactg accaggagtgaattcggcggagggaccaaggtggagatcaaacgaact -continued (amino acids)
(SEQ ID NO: 251)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYWGKGTTVTVSSGGGGSGGGGSGGGGSDIVMTQSPDSLAVSLGERATI

NCRASKSVSTSGYSYMHWYQQKPGQPPKLLIYLVSNLESGVPDRFSGSGSGTDFTLTISSLQAEDVAVYYCQHIREL

TRSEFGGGTKVEIKRT pSECTag2 E6 scFV-FC
(DNA)
(SEQ ID NO: 256)
atggagacagacacactcctgctatgggtactgctgctctgggttccaggttccactggtgacgcggcccagccggc cgaggtgcagctggtggagtctggggggaggcctggtcaagcctggggggtccctgagactctcctgtgcagcctctg gattcacctttcagtaggtatggcatgagctgggtccgccaggctccaggaagaggctggagtgggtctcaaccatt agtggcggaggcacctacatatactacccagactcagtgaagggccgattcaccatctccagagacaacgccaagaa caccctgtatctgcaaatgaacagcctgagagccgaggacacggctgtgtattactgtaccagagataactatggcc gcaactatgattatggcatggattattggggccagggcaccctggtgaccgtgagcagcggcggtggcggatccggc ggtggcggatccggcggtggcggatccgaaattgtgttgacacagtctccagccaccctgtctttgtctccagggga aagagccaccctcacctgcagcgccaccagcagtgttagctacatccactggtaccaacagaggcctggccagagcc ccaggctcctcatctatagcacctccaacctggccagcggcatcccagccaggttcagtggcagtgggtctgggagc gactacactctcaccatcagcagcctagagcctgaagattttgcagtttattactgtcagcagcgtagcagctcccc tttcacctttggcagcggcaccaaagtggaaattaaagagcccaaatcttgtgacaaaactcacacatgcccaccgt gcccagcacctgaactcctggggggaccgtcagtcttcctcttccccccaaaacccaaggacaccctcatgatctcc cggacccctgaggtcacatgcgtggtggtggacgtgagccacgaagaccctgaggtcaagttcaactggtacgtgga cggcgtggaggtgcataatgccaagacaaagccgcgggaggagcagtacaacagcacgtaccgtgtggtcagcgtcc tcaccgtcctgcaccaggactggctgaatggcaaggagtacaagtgcaaggtctccaacaaagccctcccagccccc atcgagaaaaccatctccaaagccaaagggcagccccgagaaccacaggtgtacaccctgcccccatcccgggagga gatgaccaagaaccaggtcagcctgacctgcctggtcaaaggcttctatcccagcgacatcgccgtggagtgggaga gcaatgggcagccggagaacaactacaagaccacgcctcccgtgctggactccgacggctccttcttcctctacagc aagctcaccgtggacaagagcaggtggcagcaggggaacgtcttctcatgctccgtgatgcatgaggctctgcacaa ccactacacgcagaagagcctctccctgtctccgggtaaatgataa (amino acids)
(SEQ ID NO: 257)
METDTLLLWVLLLWVPGSTGDAAQPAEVQLVESGGGLVKPGGSLRLSCAASGFTFSRYGMSWVRQAPGKRLEWVSTI

SGGGTYIYYPDSVKGRFTISRDNAKNTLYLQMNSLRAEDTAVYYCTRDNYGRNYDYGMDYWGQGTLVTVSSGGGGSG

GGGSGGGGSEIVLTQSPATLSLSPGERATLTCSATSSVSYIHWYQQRPGQSPRLLIYSTSNLASGIPARFSGSGSGS

DYTLTISSLEPEDFAVYYCQQRSSSPFTEGSGTKVEIKEPKSCDKTHTCPPCPAPELLGGPSVFLEPPKPKDTLMIS

RTPEVTCVVVDVSHEDPEVKFNWYVDGVEVHNAKTKPREEQYNSTYRVVSVLTVLHQDWLNGKEYKCKVSNKALPAP

IEKTISKAKGQPREPQVYTLPPSREEMTKNQVSLTCLVKGFYPSDIAVEWESNGQPENNYKTTPPVLDSDGSFFLYS

KLTVDKSRWQQGNVFSCSVMHEALHNHYTQKSLSLSPGK**

Human IgG1 Fc sequence:
(DNA)
(SEQ ID NO: 272)
gagcccaaatcttgtgacaaaactcacacatgcccaccgtgcccagcacctgaactcctggggggaccgtcagtctt cctcttccccccaaaacccaaggacaccctcatgatctcccggacccctgaggtcacatgcgtggtggtggacgtga gccacgaagaccctgaggtcaagttcaactggtacgtggacggcgtggaggtgcataatgccaagacaaagccgcgg gaggagcagtacaacagcacgtaccgtgtggtcagcgtcctcaccgtcctgcaccaggactggctgaatggcaagga gtacaagtgcaaggtctccaacaaagccctcccagccccatcgagaaaaccatctccaaagccaaagggcagcccc gagaaccacaggtgtacaccctgcccccatcccgggaggagatgaccaagaaccaggtcagcctgacctgcctggtc aaaggcttctatcccagcgacatcgccgtggagtgggagagcaatgggcagccggagaacaactacaagaccacgcc tcccgtgctggactccgacggctccttcttcctctacagcaagctcaccgtggacaagagcaggtggcagcaggga acgtcttctcatgctccgtgatgcatgaggctctgcacaaccactacacgcagaagagcctctccctgtctccgggt aaatgataa (amino acids)
                                                                                        (SEQ ID NO: 273)
EPKSCDKTHTCPPCPAPELLGGPSVFLFPPKPKDTLMISRTPEVTCVVVDVSHEDPEVKFNWYVDGVEVHNAKTKPR

EEQYNSTYRVVSVLTVLHQDWLNGKEYKCKVSNKALPAPIEKTISKAKGQPREPQVYTLPPSREEMTKNQVSLTCLV

KGFYPSDIAVEWESNGQPENNYKTTPPVLDSDGSFFLYSKLTVDKSRWQQGNVFSCSVMHEALHNHYTQKSLSLSPG

K**

Human IgG1 CH2—CH3 domain sequence:
(DNA)
                                                                                        (SEQ ID NO: 274)
ccgtgcccagcacctgaactcctggggggaccgtcagtcttcctcttccccccaaaacccaaggacaccctcatgat ctcccggacccctgaggtcacatgcgtggtggtggacgtgagccacgaagaccctgaggtcaagttcaactggtacg tggacggcgtggaggtgcataatgccaagacaaagccgcgggaggagcagtacaacagcacgtaccgtgtggtcagc gtcctcaccgtcctgcaccaggactggctgaatggcaaggagtacaagtgcaaggtctccaacaaagccctcccagc ccccatcgagaaaaccatctccaaagccaaagggcagccccgagaaccacaggtgtacaccctgcccccatcccggg aggagatgaccaagaaccaggtcagcctgacctgcctggtcaaaggcttctatcccagcgacatcgccgtggagtgg gagagcaatgggcagccggagaacaactacaagaccacgcctcccgtgctggactccgacggctccttcttcctcta cagcaagctcaccgtggacaagagcaggtggcagcaggggaacgtcttctcatgctccgtgatgcatgaggctctgc acaaccactacacgcagaagagcctctccctgtctccgggtaaatgataa (amino acids)
                                                                                        (SEQ ID NO: 275)
PCPAPELLGGPSVFLFPPKPKDTLMISRTPEVTCVVVDVSHEDPEVKFNWYVDGVEVHNAKTKPREEQYNSTYRVVS

VLTVLHQDWLNGKEYKCKVSNKALPAPIEKTISKAKGQPREPQVYTLPPSREEMTKNQVSLTCLVKGFYPSDIAVEW

ESNGQPENNYKTTPPVLDSDGSFFLYSKLTVDKSRWQQGNVFSCSVMHEALHNHYTQKSLSLSPGK**

Human IgG1 CH3 domain sequence:
(DNA)
                                                                                        (SEQ ID NO: 276)
gggcagccccgagaaccacaggtgtacaccctgcccccatcccgggaggagatgaccaagaaccaggtcagcctgac ctgcctggtcaaaggcttctatcccagcgacatcgccgtggagtgggagagcaatgggcagccggagaacaactaca agaccacgcctcccgtgctggactccgacggctccttcttcctctacagcaagctcaccgtggacaagagcaggtgg cagcaggggaacgtcttctcatgctccgtgatgcatgaggctctgcacaaccactacacgcagaagagcctctccct gtctccgggtaaatgataa (amino acids)
                                                                                        (SEQ ID NO: 277)
GQPREPQVYTLPPSREEMTKNQVSLTCLVKGFYPSDIAVEWESNGQPENNYKTTPPVLDSDGSFFLYSKLTVDKSRW

QQGNVFSCSVMHEALHNHYTQKSLSLSPGK**

CAR-T E6 CD8/CD8/CD28/CD3z sequence:
N-CD81s-huMNE6scFv-CD8ecd fragment- CDB transmembrane- CD28- CD3zeta-C
(DNA)
                                                                                        (SEQ ID NO: 297)
atggccctgcccgtgaccgctttgctgctccccctggcgctgctgctgcacgccgcaggccagaggtccagctggt tgagagtggcggtgggctggttaagcctggcggctccctgcggctgagctgcgccgcgagtggatttactttcagcc gatatgggatgagttgggtgcggcaagctcccgggaagaggctggaatgggtctcaacaatctccggggggggcact tacatctattaccccgactcagtcaaggggagatttaccatttcacgagacaacgctaagaataccctgtatttgca -continued gatgaattctctgagagcagaggacacagctgtttactattgtacccgcgacaactatggcaggaactacgactacg gtatggactattggggacaagggacattggttacagtgagcagtggcggcggggcagcggaggaggaggcagcggt gggggggggcagcgagatagtgctcacgcagtcacccgcgactctcagtctctcacctggggaacgagctaccctgac gtgctctgctacctcctcagtgtcatatattcactggtatcagcaacggcccgggcagtcccctagattgctcattt atagtacctctaatctggcctcaggtatccctgcacgatttttctggatctggttcaggttctgattacaccctcact atctctagcctggagcctgaagactttgccgtttattactgccagcagaggtctagctccccattcacctttgggag tgggaccaaggttgaaattaaaacgacaaccccggccccagaccaccaacgccagcccccaccatcgccagccaac ccctgtctctgagaccagaagcctgtaggcctgccgccggtggagctgtgcacacaagaggactggatttcgcctgt gatatctacatttgggccccgctcgcaggcacatgtggagtgctcctcctctccctggtgattaccctgtactgcag aagcaagcggtctcggctcctgcattctgattacatgaacatgaccccaagaagaccaggcccccaccaggaaacatt accagccctacgctccgccacgcgacttcgctgcctaccggtcccgcgttaagttctcccgatcagccgacgcgcct gcttacaagcagggccagaaccaactgtacaacgagctgaatctcggtagacgggaagagtacgacgtgttggacaa acggagaggccgcgacccagaaatgggcggcaagcctcgcaggaaaaaccccagaggggactgtacaatgagttgc agaaagataagatggcagaagcttatagcgagatcggaatgaaggggaaaggagacgagggaaaggacacgacggc ctttatcagggcctgtccacagcaacaaaagatacgtatgacgccctccatatgcaggcacttccaccacggtgata a (amino acids)
                                                                    (SEQ ID NO: 298)
MALPVTALLLPLALLLHAARPEVQLVESGGGLVKPGGSLRLSCAASGFTESRYGMSWVRQAPGKRLEWVSTISGGGT

YIYYPDSVKGRFTISRDNAKNTLYLQMNSLRAEDTAVYYCTRDNYGRNYDYGMDYWGQGTLVTVSSGGGGSGGGGSG

GGGSEIVLTQSPATLSLSPGERATLTCSATSSVSYIHWYQQRPGQSPRLLIYSTSNLASGIPARFSGSGSGSDYTLT

ISSLEPEDFAVYYCQQRSSSPFTEGSGTKVEIKTTTPAPRPPTPAPTIASQPLSLRPEACRPAAGGAVHTRGLDFAC

DIYIWAPLAGTCGVLLLSLVITLYCRSKRSRLLHSDYMNMTPRRPGPTRKHYQPYAPPRDFAAYRSRVKFSRSADAP

AYKQGQNQLYNELNLGRREEYDVLDKRRGRDPEMGGKPRRKNPQEGLYNELQKDKMAEAYSEIGMKGERRRGKGHDG

LYQGLSTATKDTYDALHMQALPPR**

CAR-T E6 CD8/CD8/4-1BB/CD3z sequence:
N-CD81s-huMNE6scFv-CD8ecd fragment- CDB transmembrane- 4-1BB- CD3zeta-C
(DNA)
                                                                    (SEQ ID NO: 300)
atggccctgcccgtgaccgctttgctgctcccctggcgctgctgctgcacgccgccaggccagaggtccagctggt tgagagtggcggtgggctggttaagcctggcggctccctgcggctgagctgcgccgcgagtggatttactttcagcc gatatgggatgagttgggtgcggcaagctcccgggaagaggctggaatgggtctcaacaatctccgggggggggcact tacatctattaccccgactcagtcaaggggagatttaccatttcacgagacaacgctaagaataccctgtatttgca gatgaattctctgagagcagaggacacagctgtttactattgtacccgcgacaactatggcaggaactacgactacg gtatggactattggggacaagggacattggttacagtgagcagtggcggcggcggggcagcggaggaggaggcagcggt gggggggggcagcgagatagtgctcacgcagtcacccgcgactctcagtctctcacctggggaacgagctaccctgac gtgctctgctacctcctcagtgtcatatattcactggtatcagcaacggcccgggcagtcccctagattgctcattt atagtacctctaatctggcctcaggtatccctgcacgatttttctggatctggttcaggttctgattacaccctcact atctctagcctggagcctgaagactttgccgtttattactgccagcagaggtctagctccccattcacctttgggag tgggaccaaggttgaaattaaaacgacaaccccggccccagaccaccaacgccagcccccaccatcgccagccaac ccctgtctctgagaccagaagcctgtaggcctgccgccggtggagctgtgcacacaagaggactggatttcgcctgt gatatctacatttgggccccgctcgcaggcacatgtggagtgctcctcctctccctggtgattaccctgtactgcaa aaggggccgcaaaaaactcctttacattttttaagcagcctttttatgaggccagtacagacgactcaagaggaagacg -continued

```
ggtgctcatgccgctttcctgaggaggaggaaggagggtgcgaactgcgcgttaagttctcccgatcagccgacgcg cctgcttacaagcagggccagaaccaactgtacaacgagctgaatctcggtagacgggaagagtacgacgtgttgga caaacggagaggccgcgacccagaaatgggcggcaagcctcgcaggaaaaaccccaggagggactgtacaatgagt tgcagaaagataagatggcagaagcttatagcgagatcggaatgaagggggaaaggagacgagggaaaggacacgac ggcctttatcagggcctgtccacagcaacaaaagatacgtatgacgccctccatatgcaggcacttccaccacggtg ataa
```

(amino acids)

(SEQ ID NO: 301)
```
MALPVTALLLPLALLLHAARPEVQLVESGGGLVKPGGSLRLSCAASGFTESRYGMSWVRQAPGKRLEWVSTISGGGT

YIYYPDSVKGRFTISRDNAKNTLYLQMNSLRAEDTAVYYCTRDNYGRNYDYGMDYWGQGTLVTVSSGGGGSGGGGSG

GGGSEIVLTQSPATLSLSPGERATLTCSATSSVSYIHWYQQRPGQSPRLLIYSTSNLASGIPARFSGSGSGSDYTLT

ISSLEPEDFAVYYCQQRSSSPFTEGSGTKVEIKTTTPAPRPPTPAPTIASQPLSLRPEACRPAAGGAVHTRGLDFAC

DIYIWAPLAGTCGVLLLSLVITLYCKRGRKKLLYIFKQPFMRPVQTTQEEDGCSCRFPEEEEGGCELRVKFSRSADA

PAYKQGQNQLYNELNLGRREEYDVLDKRRGRDPEMGGKPRRKNPQEGLYNELQKDKMAEAYSEIGMKGERRRGKGHD

GLYQGLSTATKDTYDALHMQALPPR**
```

CAR-T E6 CD8/CD8/CD28/4-1BB/CD3z sequence:
N-CD81s-huMNE6scFv-CD8ecd fragment- CDB transmembrane- CD28- 4-1BB- CD3zeta-C
(DNA)

(SEQ ID NO: 303)
```
atggcccctgcccgtgaccgctttgctgctcccctggcgctgctgctgcacgccgccaggccagaggtccagctggt tgagagtggcggtgggctggttaagcctggcggctccctgcggctgagctgcgccgcgagtggatttactttcagcc gatatgggatgagttgggtgcggcaagctcccgggaagaggctggaatgggtctcaacaatctccggggggggcact tacatctattaccccgactcagtcaaggggagatttaccatttcacgagacaacgctaagaataccctgtatttgca gatgaattctctgagagcagaggacacagctgtttactattgtacccgcgacaactatggcaggaactacgactacg gtatggactattggggacaagggacattggttacagtgagcagtggcggcgggggcagcggaggaggaggcagcggt ggggggggcagcgagatagtgctcacgcagtcacccgcgactctcagtctctcacctggggaacgagctaccctgac gtgctctgctacctcctcagtgtcatatattcactggtatcagcaacggcccgggcagtcccctagattgctcattt atagtacctctaatctggcctcaggtatccctgcacgattttctggatctggttcaggttctgattacaccctcact atctctagcctggagcctgaagactttgccgtttattactgccagcagaggtctagctcccccattcacctttgggag tgggaccaaggttgaaattaaaacgacaacccggccccagaccaccaacgccagcccccaccatcgccagccaac ccctgtctctgagaccagaagcctgtaggcctgccgccggtggagctgtgcacacaagaggactggatttcgcctgt gatatctacatttgggccccgctcgcaggcacatgtggagtgctcctcctctccctggtgattaccctgtactgcag aagcaagcggtctcggctcctgcattctgattacatgaacatgaccccaagaagaccaggccccaccaggaaacatt accagccctacgctccgccacgcgacttcgctgcctaccggtccaaaaggggccgcaaaaaactcctttacattttt aagcagccttttatgaggccagtacagacgactcaagaggaagacgggtgctcatgccgctttcctgaggaggagga aggagggtgcgaactgcgcgttaagttctcccgatcagccgacgcgcctgcttacaagcagggccagaaccaactgt acaacgagctgaatctcggtagacgggaagagtacgacgtgttggacaaacggagaggccgcgacccagaaatgggc ggcaagcctcgcaggaaaaaccccaggagggactgtacaatgagttgcagaaagataagatggcagaagcttatag cgagatcggaatgaaggggaaaggagacgagggaaaggacacgacggcctttatcagggcctgtccacagcaacaa aagatacgtatgacgccctccatatgcaggcacttccaccacggtgataa
```

(amino acids)

(SEQ ID NO: 304)
```
MALPVTALLLPLALLLHAARPEVQLVESGGGLVKPGGSLRLSCAASGFTESRYGMSWVRQAPGKRLEWVSTISGGGT

YIYYPDSVKGRFTISRDNAKNTLYLQMNSLRAEDTAVYYCTRDNYGRNYDYGMDYWGQGTLVTVSSGGGGSGGGGSG

GGGSEIVLTQSPATLSLSPGERATLTCSATSSVSYIHWYQQRPGQSPRLLIYSTSNLASGIPARFSGSGSGSDYTLT
```

-continued

ISSLEPEDFAVYYCQQRSSSPFTEGSGTKVEIKTTTPAPRPPTPAPTIASQPLSLRPEACRPAAGGAVHTRGLDFAC

DIYIWAPLAGTCGVLLLSLVITLYCRSKRSRLLBSDYMNMTPRRPGPTRKHYQPYAPPRDFAAYRSKRGRKKLLYIF

KQPFMRPVQTTQEEDGCSCRFPEEEEGGCELRVKFSRSADAPAYKQGQNQLYNELNLGRREEYDVLDKRRGRDPEMG

GKPRRKNPQEGLYNELQKDKMAEAYSEIGMKGERRRGKGHDGLYQGLSTATKDTYDALHMQALPPR**

CAR-T C2 CD8/CD8/CD28/4-1BB/CD3z sequence:
N-CD81s-huMNC2scFv-CD8ecd fragment- CDB transmembrane- CD28- 4-1BB- CD3zeta-C
(DNA)

(SEQ ID NO: 306)
atggccttgccagtgacggccctgctgctgccattggctcttctgttgcacgctgccaggcctgaagtgcagctcgt agagagtggcgggggactggtgaagcccggtggaagcctcagactcagttgcgccgcctcaggtttcacttttttcag gttacgccatgtcctgggtaagacaggcaccgggggaaaggactcgagtgggtgtctactatcagctcaggaggcact tatatatattatcctgactctgtaaaaggccgatttacgatttctcgcgacaatgcaaagaactccctctacctcca aatgaacagtcttagggcagaagacactgctgtatactattgtgcacgcctcggcggcgacaactactacgagtact ttgacgtgtgggggaaaggactaccgtgacagtttcaagcggaggaggtggctcaggtggaggcgggtcagggggg ggaggaagtgatattgtgctcacacaatcccagcctccctggctgtgtctcccggccaacgcgctacaattacatg tcgggcctccaaaagcgtgagcaccagcggctacagctacatgcactggtatcaacagaaaccaggacaaccccca aactgttgatttatctcgcttcaaacttggagtccggcgtgcctgcgcgcttttcagggagtgggagcggcacagat tttacgctgactatcaaccccgtagaagcaaacgatacagcgaattattattgtcaacattcccgggaactcccctt tacgttcggcggggggcacaaaggtcgaaattaagagaaccacgacaacccggccccagaccaccaacgccagccc ccaccatcgccagccaacccctgtctctgagaccagaagcctgtaggcctgccgccggtggagctgtgcacacaaga ggactggatttcgcctgtgatatctacatttgggcccgctcgcaggcacatgtggagtgctcctcctctccctggt gattaccctgtactgcagaagcaagcggtctcggctcctgcattctgattacatgaacatgacccaagaagaccag gccccaccaggaaacattaccagccctacgctccgccacgcgacttcgctgcctaccggtccaaaaggggccgcaaa aaactcctttacattttttaagcagcctttatgaggccagtacagacgactcaagaggaagacgggtgctcatgccg ctttcctgaggaggaggaaggagggtgcgaactgcgcgttaagttctcccgatcagccgacgcgcctgcttacaagc agggccagaaccaactgtacaacgagctgaatctcggtagacgggaagagtacgacgtgttggacaaacggagaggc cgcgacccagaaatgggcggcaagcctcgcaggaaaaaccccaggagggactgtacaatgagttgcagaaagataa gatggcagaagcttatagcgagatcggaatgaaggggggaaaggagacgagggaaaggacacgacggcctttatcagg gcctgtccacagcaacaaaagatacgtatgacgccctccatatgcaggcacttccaccacggtgataa (amino acids)

(SEQ ID NO: 307)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSGGGGSGGGGSGGGGSDIVLTQSPASLAVSPGQR

ATITCRASKSVSTSGYSYMHWYQQKPGQPPKLLIYLASNLESGVPARFSGSGSGTDFTLTINPVEANDTANYYCQHS

RELPFTEGGGTKVEIKRTTTTPAPRPPTPAPTIASQPLSLRPEACRPAAGGAVHTRGLDFACDIYIWAPLAGTCGVL

LLSLVITLYCRSKRSRLLHSDYMNMTPRRPGPTRKHYQPYAPPRDFAAYRSKRGRKKLLYIFKQPFMRPVQTTQEED

GCSCRFPEEEEGGCELRVKFSRSADAPAYKQGQNQLYNELNLGRREEYDVLDKRRGRDPEMGGKPRRKNPQEGLYNE

LQKDKMAEAYSEIGMKGERRRGKGHDGLYQGLSTATKDTYDALHMQALPPR**

Humanized E6 scFV sequence in CAR:
(DNA)

(SEQ ID NO: 341)
gaggtccagctggttgagagtggcggtgggctggttaagcctggcggctccctgcggctgagctgcgccgcgagtgg atttactttcagccgatatgggatgagttgggtgcggcaagctcccgggaagaggctggaatgggtctcaacaatct ccgggggggcacttacatctattaccccgactcagtcaaggggagatttaccctttcacgagacaacgctaagaat acccctgtatttgcagatgaattctctgagagcagaggacacagctgtttactattgtacccgcgacaactatggcag -continued gaactacgactacggtatggactattggggacaagggacattggttacagtgagcagtggcggcgggggcagcggag gaggaggcagcggtggggggggcagcgagatagtgctcacgcagtcacccgcgactctcagtctctcacctggggaa cgagctaccctgacgtgctctgctacctcctcagtgtcatatattcactggtatcagcaacggcccgggcagtcccc tagattgctcatttatagtacctctaatctggcctcaggtatccctgcacgattttctggatctggttcaggttctg attacaccctcactatctctagcctggagcctgaagactttgccgtttattactgccagcagaggtctagctcccca ttcacctttgggagtgggaccaaggttgaaattaaa (amino acids)
(SEQ ID NO: 342)
EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSSGGGGSGGGGSGGGGSEIVLTQSPATLSLSPGE

RATLTCSATSSVSYIHWYQQRPGQSPRLLIYSTSNLASGIPARFSGSGSGSDYTLTISSLEPEDFAVYYCQQRSSSP

FTFGSGTKVEIK

CD8 leader sequence:
(DNA)
(SEQ ID NO: 343)
atggccctgcccgtgaccgctttgctgctccccctggcgctgctgctgcacgccgccaggcca (amino acids)
(SEQ ID NO: 344)
MALPVTALLLPLALLLHAARP CD8 hinge domain sequence:
(DNA)
(SEQ ID NO: 345)
acgacaaccccggcccccagaccaccaacgccagcccccaccatcgccagccaacccctgtctctgagaccagaagc ctgtaggcctgccgccggtggagctgtgcacacaagaggactggatttcgcctgtgat (amino acids)
(SEQ ID NO: 346)
TTTPAPRPPTPAPTIASQPLSLRPEACRPAAGGAVHTRGLDFACD CD4 hinge domain sequence:
(DNA)
(SEQ ID NO: 347)
tcgggacaggtcctgctggaatccaacatcaaggttctgcccacatggtccaccccggtgcagcca (amino acids)
(SEQ ID NO: 348)
SGQVLLESNIKVLPTWSTPVQP CD28 hinge domain sequence:
(DNA)
(SEQ ID NO: 349)
aaacacctttgtccaagtcccctatttcccggaccttctaagccc (amino acids)
(SEQ ID NO: 350)
KHLCPSPLFPGPSKP CD3 zeta transmembrane domain sequence:
(DNA)
(SEQ ID NO: 361)
ctctgctacctgctggatggaatcctcttcatctatggtgtcattctcactgccttgttcctg (amino acids)
(SEQ ID NO: 362)
LCYLLDGILFIYGVILTALFL CD8 transmembrane domain sequence:
(DNA)
(SEQ ID NO: 363)
atctacatttgggccccgctcgcaggcacatgtggagtgctcctcctctccctggtgattaccctgtactgc (amino acids)
(SEQ ID NO: 364)
IYIWAPLAGTCGVLLLSLVITLYC -continued CD4 transmembrane domain sequence:
(DNA)

(SEQ ID NO: 365)

atggccctgattgtgctggggggcgtcgccggcctcctgcttttcattgggctaggcatcttcttc (amino acids)

(SEQ ID NO: 366)

MALIVLGGVAGLLLFIGLGIFF

CD28 transmembrane domain sequence:
(DNA)

(SEQ ID NO: 367)

ttttgggtgctggtggtggttggtggagtcctggcttgctatagcttgctagtaacagtggcctttattattttctg ggtg (amino acids)

(SEQ ID NO: 368)

FWVLVVVGGVLACYSLLVTVAFIIFWV 4-1BB transmembrane domain sequence:
(DNA)

(SEQ ID NO: 369)

atcatctccttcttcttgcgctgacgtcgactgcgttgctcttcctgctgttcttcctcacgctccgtttctctgt tgtt (amino acids)

(SEQ ID NO: 370)

IISFFLALTSTALLFLLFFLTLRFSVV

OX40 transmembrane domain sequence:
(DNA)

(SEQ ID NO: 371)

gttgccgccatcctgggcctgggcctggtgctggggctgctgggccccctggccatcctgctggccctgtacctgct c (amino acids)

(SEQ ID NO: 372)

VAAILGLGLVLGLLGPLAILLALYLL

CD3 zeta domain sequence:
(DNA)

(SEQ ID NO: 373)

cgcgttaagttctcccgatcagccgacgcgcctgcttacaagcagggccagaaccaactgtacaacgagctgaatct cggtagacgggaagagtacgacgtgttggacaaacggagaggccgcgacccagaaatgggcggcaagcctcgcagga aaaaccccaggagggactgtacaatgagttgcagaaagataagatggcagaagcttatagcgagatcggaatgaag ggggaaaggagacgagggaaaggacacgacggcctttatcagggcctgtccacagcaacaaaagatacgtatgacgc cctccatatgcaggcacttccaccacgg (amino acids)

(SEQ ID NO: 374)

RVKFSRSADAPAYKQGQNQLYNELNLGRREEYDVLDKRRGRDPEMGGKPRRKNPQEGLYNELQKDKMAEAYSEIGMK

GERRRGKGHDGLYQGLSTATKDTYDALHMQALPPR

CD3 zeta domain variant sequence:
(DNA)

(SEQ ID NO: 375)

agagtgaagttcagcaggagcgcagacgcccccgcgtaccagcagggccagaaccagctctataacgagctcaatct aggacgaagagaggagtacgatgtttttggacaagagacgtggccgggaccctgagatggggggaaagccgagaagga agaaccctcaggaaggcctgtacaatgaactgcagaaagataagatggcggaggcctacagtgagattgggatgaaa ggcgagcgccggagggggcaaggggcacgatggcctttaccagggtctcagtacagccaccaaggacacctacgacgc ccttcacatgcaggccctgccccctcgc (amino acids)

(SEQ ID NO: 376)

RVKFSRSADAPAYQQGQNQLYNELNLGRREEYDVLDKRRGRDPEMGGKPRRKNPQEGLYNELQKDKMAEAYSEIGMK

GERRRGKGHDGLYQGLSTATKDTYDALHMQALPPR

-continued

CD28 domain sequence:
(DNA)

(SEQ ID NO: 377)

agaagcaagcggtctcggctcctgcattctgattacatgaacatgacccccaagaagaccaggcccccaccaggaaaca ttaccagccctacgctccgccacgcgacttcgctgcctaccggtcc (amino acids)

(SEQ ID NO: 378)

RSKRSRLLHSDYMNMTPRRPGPTRKHYQPYAPPRDFAAYRS 4-1BB domain sequence:
(DNA)

(SEQ ID NO: 379)

aaaaggggccgcaaaaaactcctttacattttttaagcagcctttttatgaggccagtacagacgactcaagaggaaga cgggtgctcatgccgctttcctgaggaggaggaaggagggtgcgaactg (amino acids)

(SEQ ID NO: 380)

KRGRKKLLYIFKQPFMRPVQTTQEEDGCSCRFPEEEEGGCEL

HumanizeE6 scFV (VH-VL) sequence:
(DNA)

(SEQ ID NO: 391)

gaggtgcagctggtggagtctggggggaggcctggtcaagcctggggggtccctgagactctcctgtgcagcctctgg attcaccttcagtaggtatggcatgagctgggtccgccaggctccagggaagaggctggagtgggtctcaaccatta gtggcggaggcacctacatatactacccagactcagtgaagggccgattcaccatctccagagacaacgccaagaac accctgtatctgcaaatgaacagcctgagagccgaggacacggctgtgtattactgtaccagagataactatggccg caactatgattatggcatggattattggggccagggcaccctggtgaccgtgagcagcggcggtggcggatccggcg gtggcggatccggcggtggcggatccgaaattgtgttgacacagtctccagccaccctgtctttgtctccaggggaa agagccaccctcacctgcagcgccaccagcagtgttagctacatccactggtaccaacagaggcctggccagagccc caggctcctcatctatagcacctccaacctggccagcggcatcccagccaggttcagtggcagtgggtctgggagcg actacactctcaccatcagcagcctagagcctgaagattttgcagtttattactgtcagcagcgtagcagctcccct ttcacctttggcagcggcaccaaagtggaaattaaa (amino acids)

(SEQ ID NO: 392)

EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSSGGGGSGGGGSGGGGSEIVLTQSPATLSLSPGE

RATLTCSATSSVSYIHWYQQRPGQSPRLLIYSTSNLASGIPARFSGSGSGSDYTLTISSLEPEDFAVYYCQQRSSSP

FTFGSGTKVEIK

HumanizeE6 scFV (VL-VH) sequence:
(DNA)

(SEQ ID NO: 393)

gaaattgtgttgacacagtctccagccaccctgtctttgtctccaggggaaagagccaccctcacctgcagcgccac cagcagtgttagctacatccactggtaccaacagaggcctggccagagccccaggctcctcatctatagcacctcca acctggccagcggcatcccagccaggttcagtggcagtgggtctgggagcgactacactctcaccatcagcagccta gagcctgaagattttgcagtttattactgtcagcagcgtagcagctcccctttcacctttggcagcggcaccaaagt ggaaattaaaggcggtggcggatccggcggtggcggatccggcggtggcggatccgaggtgcagctggtggagtctg gggggaggcctggtcaagcctggggggtccctgagactctcctgtgcagcctctggattcaccttcagtaggtatggc atgagctgggtccgccaggctccagggaagaggctggagtgggtctcaaccattagtggcggaggcacctacatata ctacccagactcagtgaagggccgattcaccatctccagagacaacgccaagaacaccctgtatctgcaaatgaaca gcctgagagccgaggacacggctgtgtattactgtaccagagataactatggccgcaactatgattatggcatggat tattggggccagggcaccctggtgaccgtgagcagc -continued (amino acids)

(SEQ ID NO: 394)

EIVLTQSPATLSLSPGERATLTCSATSSVSYIHWYQQRPGQSPRLLIYSTSNLASGIPARFSGSGSGSDYTLTISSL

EPEDFAVYYCQQRSSSPFTFGSGTKVEIKGGGGSGGGGSGGGGSEVQLVESGGGLVKPGGSLRLSCAASGFTFSRYG

MSWVRQAPGKRLEWVSTISGGGTYIYYPDSVKGRFTISRDNAKNTLYLQMNSLRAEDTAVYYCTRDNYGRNYDYGMD

YWGQGTLVTVSS

HumanizeC2 scFV (VH-VL) sequence:
(DNA)

(SEQ ID NO: 395)

gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttggggggggataa ttactacgaatacttcgatgtctggggcaaagggaccacggtcaccgtctcctccggcggtggcggatccggcggtg gcggatccggcggtggcggatccgacattgtgctgacccagtctccagcctccttggccgtgtctccaggacagagg gccaccatcacctgcagagccagtaagagtgtcagtaccagcggatactcctacatgcactggtatcagcagaaacc aggacaacctcctaaactcctgatttacctggcatccaatctggagagcggggtcccagccaggttcagcggcagtg ggtctgggaccgatttcaccctcacaattaatcctgtggaagctaatgatactgcaaattattactgtcagcacagt agggagctgcctttcacattcggcggagggaccaaggtggagatcaaacgaact (amino acids)

(SEQ ID NO: 396)

EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSGGGGSGGGGSGGGGSDIVLTQSPASLAVSPGQR

ATITCRASKSVSTSGYSYMHWYQQKPGQPPKLLIYLASNLESGVPARFSGSGSGTDFTLTINPVEANDTANYYCQHS

RELPFTFGGGTKVEIKRT

HumanizeE6 scFV (VL-VH) sequence:
(DNA)

(SEQ ID NO: 397)

gacattgtgctgacccagtctccagcctccttggccgtgtctccaggacagagggccaccatcacctgcagagccag taagagtgtcagtaccagcggatactcctacatgcactggtatcagcagaaaccaggacaacctcctaaactcctga tttacctggcatccaatctggagagcggggtcccagccaggttcagcggcagtgggtctgggaccgatttcaccctc acaattaatcctgtggaagctaatgatactgcaaattattactgtcagcacagtagggagctgcctttcacattcgg cggagggaccaaggtggagatcaaacgaactggcggtggcggatccggcggtggcggatccggcggtggcggatccg aggtgcagctggtggagtctggggggaggcctggtcaagcctggggggtccctgagactctcctgtgcagcctctgga ttcaccttcagtggctatgccatgagctgggtccgccaggctccagggaaggggctggagtgggtctcaaccattag tagtggcggaacctacatatactaccccgactcagtgaagggccgattcaccatctccagagacaacgccaagaact cactgtatctgcaaatgaacagcctgagagccgaggacacggccgtgtattactgtgcgagacttggggggggataat tactacgaatacttcgatgtctggggcaaagggaccacggtcaccgtctcctcc (amino acids)

(SEQ ID NO: 398)

DIVLTQSPASLAVSPGQRATITCRASKSVSTSGYSYMHWYQQKPGQPPKLLIYLASNLESGVPARFSGSGSGTDFTL

TINPVEANDTANYYCQHSRELPFTFGGGTKVEIKRTGGGGSGGGGSGGGGSEVQLVESGGGLVKPGGSLRLSCAASG

FTFSGYAMSWVRQAPGKGLEWVSTISSGGTYIYYPDSVKGRFTISRDNAKNSLYLQMNSLRAEDTAVYYCARLGGDN

YYEYFDVWGKGTTVTVSS

-continued

G4S1 (SEQ ID NO: 400) linker sequence:
(DNA)

(SEQ ID NO: 399)

ggcggtggcggatcc (amino acids)

(SEQ ID NO: 400)

GGGGS

[G4S1]x3 (SEQ ID NO: 402) linker sequence:
(DNA)

(SEQ ID NO: 401)

ggcggtggcggatccggcggtggcggatccggcggtggcggatcc (amino acids)

(SEQ ID NO: 402)

GGGGSGGGGSGGGGS 8 aa GS linker (SEQ ID NO: 404) sequence:
(DNA)

(SEQ ID NO: 403)

ggcggttccggcggtggatccgga (amino acids)

(SEQ ID NO: 404)

GGSGGGSG 12 aa GS linker (SEQ ID NO: 406) sequence:
(DNA)

(SEQ ID NO: 405)

ggcggttccggcggtggatccggcggtggcggatccgga (amino acids)

(SEQ ID NO: 406)

GGSGGGSGGGSG 13 aa GS linker (SEQ ID NO: 408) sequence:
(DNA)

(SEQ ID NO: 407)

ggcggtggatccggcggtggcggatccggcggtggatcc (amino acids)

(SEQ ID NO: 408)

GGGSGGGGSGGGS 22 aa GS linker (SEQ ID NO: 410) sequence:
(DNA)

(SEQ ID NO: 409)

ggcggtggaagcggcggtggcggatccggcagcggcggaagcggcggtggcggatccggcggtgga (amino acids)

(SEQ ID NO: 410)

GGGSGGGGSGSGGSGGGGSGGG 24 aa GS linker (SEQ ID NO: 412) sequence:
(DNA)

(SEQ ID NO: 411)

ggcggttccggcggtggatccggcggtggcggatccggaggcggttccggcggtggatccggcggtggcggatccgg a (amino acids)

(SEQ ID NO: 412)

GGSGGGSGGGSGGGSGGGSGGGSG

Mouse C3 Heavy chain variable region sequence:
(DNA)

(SEQ ID NO: 413)

caggtccagctgcagcagtctgggcctgagctggtgaggcctggggtctcagtgaagatttcctgcaagggttccgg ctacagattcactgattatgctatgaactgggtgaagcagagtcatgcaaagagtctagagtggattggagttatta gtactttctctggtaatacaaacttcaaccagaagtttaagggcaaggccacaatgactgtagacaaatcctccagc acagcctatatggaacttgccagattgacatctgaggattctgccatgtattactgtgcaagatcggattactacgg cccatactttgactactggggccaaggcaccactctcacagtctcctca -continued (amino acids)
                                                          (SEQ ID NO: 414)
QVQLQQSGPELVRPGVSVKISCKGSGYRFTDYAMNWVKQSHAKSLEWIGVISTFSGMTNENQKFKGKATMTVDKSSS

TAYMELARLTSEDSAMYYCARSDYYGPYFDYWGQGTTLTVSS

Mouse C3 heavy chain variable framework region 1 (FWR1) sequence:
(DNA)
                                                          (SEQ ID NO: 415)
caggtccagctgcagcagtctgggcctgagctggtgaggcctggggtctcagtgaagatttcctgcaagggttccgg ctacagattcact (amino acids)
                                                          (SEQ ID NO: 416)
QVQLQQSGPELVRPGVSVKISCKGSGYRFT Mouse C3 heavy chain variable complementarity determining regions 1 (CDR1)
sequence:
(DNA)
                                                          (SEQ ID NO: 417)
gattatgctatgaac (amino acids)
                                                          (SEQ ID NO: 418)
DYAMN Mouse C3 heavy chain variable framework region 2 (FWR2) sequence:
(DNA)
                                                          (SEQ ID NO: 419)
tgggtgaagcagagtcatgcaaagagtctagagtggattgga (amino acids)
                                                          (SEQ ID NO: 420)
WVKQSHAKSLEWIG Mouse C3 heavy chain variable complementarity determining regions 2 (CDR2)
sequence:
(DNA)
                                                          (SEQ ID NO: 421)
gttattagtactttctctggtaatacaaacttcaaccagaagtttaagggc (amino acids)
                                                          (SEQ ID NO: 422)
VISTFSGNTNFNQKFKG Mouse C3 heavy chain variable framework region 3 (FWR3) acid sequence:
(DNA)
                                                          (SEQ ID NO: 423)
aaggccacaatgactgtagacaaatcctccagcacagcctatatggaacttgccagattgacatctgaggattctgc catgtattactgtgcaaga (amino acids)
                                                          (SEQ ID NO: 424)
KATMTVDKSSSTAYMELARLTSEDSAMYYCAR Mouse C3 heavy chain variable complementarity determining regions 3 (CDR3)
sequence:
(DNA)
                                                          (SEQ ID NO: 425)
tcggattactacggcccatactttgactac (amino acids)
                                                          (SEQ ID NO: 426)
SDYYGPYFDY Humanized C3 heavy chain variable region sequence from IGHV1-18*04:
(DNA)
                                                          (SEQ ID NO: 439)
caggttcagctggtgcagtctggagctgaggtgaagaagcctggggcctcagtgaaggtctcctgcaaggcttctgg ttacacctttaccgactacgccatgaactgggtgcgacaggcccctggacaagggcttgagtggatgggagtgatca gcaccttcagcggtaacacaaacttcaaccagaagttcaagggcagagtcaccatgaccacagacacatccacgagc acagcctacatggagctgaggagcctgagatctgacgacacggccgtgtattactgtgcgagaagcgactactacgg cccatacttcgactactggggccagggcaccaccctgaccgtgtccagc (amino acids)

(SEQ ID NO: 440)

QVQLVQSGAEVKKPGASVKVSCKASGYTFTDYAMNWVRQAPGQGLEWMGVISTFSGNTNFNQKFKGRVTMTTDTSTS

TAYMELRSLRSDDTAVYYCARSDYYGPYFDYWGQGTTLTVSS

Humanized C3 heavy chain variable framework region 1 (FWR1) acid sequence:
(DNA)

(SEQ ID NO: 441)

caggttcagctggtgcagtctggagctgaggtgaagaagcctggggcctcagtgaaggtctcctgcaaggcttctgg ttacacctttacc (amino acids)

(SEQ ID NO: 442)

QVQLVQSGAEVKKPGASVKVSCKASGYTFT

Humanized C3 heavy chain variable complementarity determining regions 1 (CDR1)
sequence:
(DNA)

(SEQ ID NO: 443)

gactacgccatgaac (amino acids)

(SEQ ID NO: 444)

DYAMN

Humanized C3 heavy chain variable framework region 2 (FWR2) acid sequence:
(DNA)

(SEQ ID NO: 445)

tgggtgcgacaggcccctggacaagggcttgagtggatggga (amino acids)

(SEQ ID NO: 446)

WVRQAPGQGLEWMG

Humanized C3 heavy chain variable complementarity determining regions 2
(CDR2) sequence:
(DNA)

(SEQ ID NO: 447)

gtgatcagcaccttcagcggtaacacaaacttcaaccagaagttcaagggc (amino acids)

(SEQ ID NO: 448)

VISTFSGNTNFNQKFKG

Humanized C3 heavy chain variable framework region 3 (FWR3) acid sequence:
(DNA)

(SEQ ID NO: 449)

agagtcaccatgaccacagacacatccacgagcacagcctacatggagctgaggagcctgagatctgacgacacggc cgtgtattactgtgcgaga (amino acids)

(SEQ ID NO: 450)

RVTMTTDTSTSTAYMELRSLRSDDTAVYYCAR

Humanized C3 heavy chain variable complementarity determining regions 3
(CDR3) sequence:
(DNA)

(SEQ ID NO: 451)

agcgactactacggcccatacttcgactac (amino acids)

(SEQ ID NO: 452)

SDYYGPYFDY

Humanized C3 IgG1 heavy chain sequence
(DNA)

(SEQ ID NO: 453)

caggttcagctggtgcagtctggagctgaggtgaagaagcctggggcctcagtgaaggtctcctgcaaggcttctgg ttacacctttaccgactacgccatgaactgggtgcgacaggcccctggacaagggcttgagtggatgggagtgatca gcaccttcagcggtaacacaaacttcaaccagaagttcaagggcagagtcaccatgaccacagacacatccacgagc acagcctacatggagctgaggagcctgagatctgacgacacggccgtgtattactgtgcgagaagcgactactacgg cccatacttcgactactggggccagggcaccaccctgaccgtgtccagcgctagcaccaagggcccatcggtcttcc -continued ccctggcaccctcctccaagagcacctctgggggcacagcggccctgggctgcctggtcaaggactacttccccgaa ccggtgacggtgtcgtggaactcaggcgccctgaccagcggcgtgcacaccttcccggctgtcctacagtcctcagg actctactccctcagcagcgtggtgacagtgccctccagcagcttgggcacccagacctacatctgcaacgtgaatc acaagcccagcaacaccaaggtggacaagaaagttgagcccaaatcttgtgacaaaactcacacatgcccaccgtgc ccagcacctgaactcctggggggaccgtcagtcttcctcttccccccaaaacccaaggacaccctcatgatctcccg gacccctgaggtcacatgcgtggtggtggacgtgagccacgaagaccctgaggtcaagttcaactggtacgtggacg gcgtggaggtgcataatgccaagacaaagccgcgggaggagcagtacaacagcacgtaccgtgtggtcagcgtcctc accgtcctgcaccaggactggctgaatggcaaggagtacaagtgcaaggtctccaacaaagccctcccagcccccat cgagaaaaccatctccaaagccaaagggcagccccgagaaccacaggtgtacaccctgcccccatcccgggaggaga tgaccaagaaccaggtcagcctgacctgcctggtcaaaggcttctatcccagcgacatcgccgtggagtgggagagc aatgggcagccggagaacaactacaagaccacgcctcccgtgctggactccgacggctccttcttcctctacagcaa gctcaccgtggacaagagcaggtggcagcaggggaacgtcttctcatgctccgtgatgcatgaggctctgcacaacc actacacgcagaagagcctctccctgtctccgggtaaatgataa (amino acids)

(SEQ ID NO: 454)

QVQLVQSGAEVKKPGASVKVSCKASGYTFTDYAMNWVRQAPGQGLEWMGVISTFSGNTNFNQKFKGRVTMTTDTSTS

TAYMELRSLRSDDTAVYYCARSDYYGPYFDYWGQGTTLTVSSASTKGPSVFPLAPSSKSTSGGTAALGCLVKDYFPE

PVTVSWNSGALTSGVHTFPAVLQSSGLYSLSSVVTVPSSSLGTQTYICNVNHKPSNTKVDKKVEPKSCDKTHTCPPC

PAPELLGGPSVFLEPPKPKDTLMISRTPEVTCVVVDVSHEDPEVKFNWYVDGVEVHNAKTKPREEQYNSTYRVVSVL

TVLHQDWLNGKEYKCKVSNKALPAPIEKTISKAKGQPREPQVYTLPPSREEMTKNQVSLTCLVKGFYPSDIAVEWES

NGQPENNYKTTPPVLDSDGSFFLYSKLTVDKSRWQQGNVESCSVMHEALHNHYTQKSLSLSPGK**

Humanized C3 IgG2 heavy chain sequence
(DNA)

(SEQ ID NO: 455)

caggttcagctggtgcagtctggagctgaggtgaagaagcctggggcctcagtgaaggtctcctgcaaggcttctgg ttacacctttaccgactacgccatgaactgggtgcgacaggcccctggacaagggcttgagtggatgggagtgatca gcaccttcagcggtaacacaaacttcaaccagaagttcaagggcagagtcaccatgaccacagacacatccacgagc acagcctacatggagctgaggagcctgagatctgacgacacggccgtgtattactgtgcgagaagcgactactacgg cccatacttcgactactggggccagggcaccaccctgaccgtgtccagcgcctccaccaagggcccatcggtcttcc ccctggcgccctgctccaggagcacctccgagagcacagccgccctgggctgcctggtcaaggactacttccccgaa ccggtgacggtgtcgtggaactcaggcgctctgaccagcggcgtgcacaccttcccagctgtcctacagtcctcagg actctactccctcagcagcgtggtgaccgtgccctccagcaacttcggcacccagacctacacctgcaacgtagatc acaagcccagcaacaccaaggtggacaagacagttgagcgcaaatgttgtgtcgagtgcccaccgtgcccagcacca cctgtggcaggaccgtcagtcttcctcttccccccaaaacccaaggacaccctcatgatctcccggacccctgaggt cacgtgcgtggtggtggacgtgagccacgaagaccccgaggtccagttcaactggtacgtggacggcgtggaggtgc ataatgccaagacaaagccacgggaggagcagttcaacagcacgttccgtgtggtcagcgtcctcaccgttgtgcac caggactggctgaacggcaaggagtacaagtgcaaggtctccaacaaaggcctcccagcccccatcgagaaaaccat ctccaaaaccaaagggcagccccgagaaccacaggtgtacaccctgcccccatcccgggaggagatgaccaagaacc aggtcagcctgacctgcctggtcaaaggcttctaccccagcgacatcgccgtggagtgggagagcaatgggcagccg gagaacaactacaagaccacacctcccatgctggactccgacggctccttcttcctctacagcaagctcaccgtgga caagagcaggtggcagcaggggaacgtcttctcatgctccgtgatgcatgaggctctgcacaaccactacacgcaga gagagcctctccctgtctccgggtaaatagtaa -continued (amino acids)

(SEQ ID NO: 456)

QVQLVQSGAEVKKPGASVKVSCKASGYTFTDYAMNWVRQAPGQGLEWMGVISTFSGNTNFNQKFKGRVTMTTDTSTS

TAYMELRSLRSDDTAVYYCARSDYYGPYFDYWGQGTTLTVSSASTKGPSVFPLAPCSRSTSESTAALGCLVKDYFPE

PVTVSWNSGALTSGVHTFPAVLQSSGLYSLSSVVTVPSSNFGTQTYTCNVDHKPSNTKVDKTVERKCCVECPPCPAP

PVAGPSVFLFPPKPKDTLMISRTPEVTCVVVDVSHEDPEVQFNWYVDGVEVHNAKTKPREEQFNSTFRVVSVLTVVH

QDWLNGKEYKCKVSNKGLPAPIEKTISKTKGQPREPQVYTLPPSREEMTKNQVSLTCLVKGFYPSDIAVEWESNGQP

ENNYKTTPPMLDSDGSFFLYSKLTVDKSRWQQGNVFSCSVMHEALHNHYTQKSLSLSPGK**

Mouse C3 Light Chain variable region sequence:
(DNA)

(SEQ ID NO: 458)

gatgttttgatgacccaaactccactctccctgcctgtcagtcttggagatcaagcctccatctcttgcagatctag tcagaccattgtacatagtaatggaaacacctatttagaatggtacctgcagaaaccaggccagtctccaaagctcc tgatctacaaagtttccaaccgattttctggggtcccagacaggttcagtggcagtggatcagggacagatttcaca ctcaagatcaacagagtggaggctgaggatctgggagtttattactgctttcaaggttcacatgttccattcacgtt cggctcggggacaaagttggaaataaaa (amino acids)

(SEQ ID NO: 459)

DVLMTQTPLSLPVSLGDQASISCRSSQTIVHSNGNTYLEWYLQKPGQSPKLLIYKVSNRFSGVPDRFSGSGSGTDFT

LKINRVEAEDLGVYYCFQGSHVPFTFGSGTKLEIK

Mouse C3 light chain variable framework region 1 (FWR1) sequence :
(DNA)

(SEQ ID NO: 460)

gatgttttgatgacccaaactccactctccctgcctgtcagtcttggagatcaagcctccatctcttgc (amino acids)

(SEQ ID NO: 461)

DVLMTQTPLSLPVSLGDQASISC

Mouse C3 light chain variable complementarity determining regions 1 (CDR1)
sequence:
(DNA)

(SEQ ID NO: 462)

agatctagtcagaccattgtacatagtaatggaaacacctatttagaa (amino acids)

(SEQ ID NO: 463)

RSSQTIVHSNGNTYLE

Mouse C3 light chain variable framework region 2 (FWR2) sequence:
(DNA)

(SEQ ID NO: 464)

tggtacctgcagaaaccaggccagtctccaaagctcctgatctac (amino acids)

(SEQ ID ON: 465)

WYLQKPGQSPKLLIY

Mouse C3 light chain variable complementarity determining regions 2 (CDR2)
sequence:
(DNA)

(SEQ ID NO: 466)

aaagtttccaaccgattttct (amino acids)

(SEQ ID NO: 467)

KVSNRFS

Mouse C3 light chain variable framework region 3 (FWR3) sequence:
(DNA)

(SEQ ID NO: 468)

ggggtcccagacaggttcagtggcagtggatcagggacagatttcacactcaagatcaacagagtggaggctgagga tctgggagtttattactgc -continued (amino acids)
                                                              (SEQ ID NO: 469)
GVPDRFSGSGSGTDFTLKINRVEAEDLGVYYC Mouse C3 light chain variable complementarity determining regions 3 (CDR3)
sequence:
(DNA)
                                                              (SEQ ID NO: 470)
tttcaaggttcacatgttccattcacg (amino acids)
                                                              (SEQ ID NO: 471)
FQGSHVPFT Humanized C3 light chain variable region sequence from IGKV2-29*03:
(DNA)
                                                              (SEQ ID NO: 486)
gatattgtgatgacccagactccactctctctgtccgtcacccctggacagccggcctccatctcctgcaggtctag tcagaccattgtccatagtaatggaaacacctatttggagtggtacctgcagaagccaggccagtctccacagctcc tgatctataaggtttccaaccggttctctggagtgccagataggttcagtggcagcgggtcagggacagatttcaca ctgaaaatcagccgggtggaggctgaggatgttggggtttattactgcttccaaggtagccacgtgcctttcacctt cggcggagggaccaaggtggagatcaaacgaact (amino acids)
                                                              (SEQ ID NO: 487)
DIVMTQTPLSLSVTPGQPASISCRSSQTIVHSNGNTYLEWYLQKPGQSPQLLIYKVSNRFSGVPDRFSGSGSGTDFT

LKISRVEAEDVGVYYCFQGSHVPFTFGGGTKVEIKRT

Humanized C3 light chain variable framework region 1 (FWR1) acid sequence:
(DNA)
                                                              (SEQ ID NO: 488)
gatattgtgatgacccagactccactctctctgtccgtcacccctggacagccggcctccatctcctgc (amino acids)
                                                              (SEQ ID NO: 489)
DIVMTQTPLSLSVTPGQPASISC Humanized C3 light chain variable complementarity determining regions 1 (CDR1)
sequence:
(DNA)
                                                              (SEQ ID NO: 490)
ggtctagtcagaccattgtccatagtaatggaaacacctatttggag (amino acids)
                                                              (SEQ ID NO: 491)
RSSQTIVHSNGNTYLE Humanized C3 light chain variable framework region 2 (FWR2) acid sequence:
(DNA)
                                                              (SEQ ID NO: 492)
tggtacctgcagaagccaggccagtctccacagctcctgatctat (amino acids)
                                                              (SEQ ID NO: 493)
WYLQKPGQSPQLLIY Humanized C3 light chain variable complementarity determining regions 2
(CDR2) sequence:
(DNA)
                                                              (SEQ ID NO: 494)
aaggtttccaaccggttctct (amino acids)
                                                              (SEQ ID NO: 495)
KVSNRFS Humanized C3 light chain variable framework region 3 (FWR3) acid sequence:
(DNA)
                                                              (SEQ ID NO: 496)
ggagtgccagataggttcagtggcagcgggtcagggacagatttcacactgaaaatcagccgggtggaggctgagga tgttggggtttattactgc -continued (amino acids)

(SEQ ID NO: 497)

GVPDRFSGSGSGTDFTLKISRVEAEDVGVYYC

Humanized C3 light chain variable complementarity determining regions 3
(CDR3) sequence:
(DNA)

(SEQ ID NO: 498)

ttccaaggtagccacgtgcctttcacc (amino acids)

(SEQ ID NO: 499)

FQGSHVPFT

Humanized C3 lambda light chain sequence
(DNA)

(SEQ ID NO: 500)

gatattgtgatgacccagactccactctctctgtccgtcacccctggacagccggcctccatctcctgcaggtctag tcagaccattgtccatagtaatggaaacacctatttggagtggtacctgcagaagccaggccagtctccacagctcc tgatctataaggtttccaaccggttctctggagtgccagataggttcagtggcagcgggtcagggacagatttcaca ctgaaaatcagccgggtggaggctgaggatgttggggtttattactgcttccaaggtagccacgtgcctttcacctt cggcggagggaccaaggtggagatcaaacgaactggtcagcccaaggctgccccctcggtcactctgttcccgccct cctctgaggagcttcaagccaacaaggccacactggtgtgtctcataagtgacttctacccgggagccgtgacagtg gcctggaaggcagatagcagccccgtcaaggcgggagtggagaccaccacaccctccaaacaaagcaacaacaagta cgcggccagcagctatctgagcctgacgcctgagcagtggaagtcccacagaagctacagctgccaggtcacgcatg aagggagcaccgtggagaagacagtggcccctacagaatgttcatagtaa (amino acids)

(SEQ ID NO: 501)

DIVMTQTPLSLSVTPGQPASISCRSSQTIVHSNGNTYLEWYLQKPGQSPQLLIYKVSNRFSGVPDRFSGSGSGTDFT

LKISRVEAEDVGVYYCFQGSHVPFTFGGGTKVEIKRTGQPKAAPSVTLFPPSSEELQANKATLVCLISDFYPGAVTV

AWKADSSPVKAGVETTTPSKQSNNKYAASSYLSLTPEQWKSHRSYSCQVTHEGSTVEKTVAPTECS**

Humanized C3 Kappa light chain
(DNA)

(SEQ ID NO: 502)

gatattgtgatgacccagactccactctctctgtccgtcacccctggacagccggcctccatctcctgcaggtctag tcagaccattgtccatagtaatggaaacacctatttggagtggtacctgcagaagccaggccagtctccacagctcc tgatctataaggtttccaaccggttctctggagtgccagataggttcagtggcagcgggtcagggacagatttcaca ctgaaaatcagccgggtggaggctgaggatgttggggtttattactgcttccaaggtagccacgtgcctttcacctt cggcggagggaccaaggtggagatcaaacgaactacggtggctgcaccatctgtcttcatcttcccgccatctgatg agcagttgaaatctggaactgcctctgttgtgtgcctgctgaataacttctatcccagagaggccaaagtacagtgg aaggtggataacgccctccaatcgggtaactcccaggagagtgtcacagagcaggacagcaaggacagcacctacag cctcagcagcaccctgacgctgagcaaagcagactacgagaaacacaaagtctacgcctgcgaagtcacccatcagg gcctgagctcgcccgtcacaaagagcttcaacaggggagagtgttagtaa (amino acids)

(SEQ ID NO: 503)

DIVMTQTPLSLSVTPGQPASISCRSSQTIVHSNGNTYLEWYLQKPGQSPQLLIYKVSNRFSGVPDRFSGSGSGTDFT

LKISRVEAEDVGVYYCFQGSHVPFTFGGGTKVEIKRTTVAAPSVFIFPPSDEQLKSGTASVVCLLNNFYPREAKVQW

KVDNALQSGNSQESVTEQDSKDSTYSLSSTLTLSKADYEKHKVYACEVTHQGLSSPVTKSFNRGEC**

Mouse C8 heavy chain variable region sequence
(DNA)

(SEQ ID NO: 505)

gaagtgatggtcgtggaaagcggcggtggtctggtaaagccggggggatcccttaagctttcttgcgccgcatccgg gttcacgttctccggctatgccatgtcctgggtccgacagactcccgaaaagcgcttggaatgggtggccactatct cctccggggggacgtacatctactaccccgacagtgtgaaggaagatttacaatatctcgcgacaacgcaaaaaat -continued accttgtatcttcaaatgagctccctgcggtcagaggacactgccatgtactattgcgcccgcctgggcggcgacaa ttactatgagtat (amino acids)
                                                          (SEQ ID NO: 506)
EVMVVESGGGLVKPGGSLKLSCAASGETFSGYAMSWVRQTPEKRLEWVATISSGGTYIYYPDSVKGRETISRDNAKNT

LYLQMSSLRSEDTAMYYCARLGGDNYYEY

Mouse C8 heavy chain variable complementarity determining region 1 (CDR1)
sequence:
(DNA)
                                                          (SEQ ID NO: 507)
ggctatgccatgtcc (amino acids)
                                                          (SEQ ID NO: 508)
GYAMS Mouse C8 heavy chain variable complementarity determining region 2 (CDR2)
sequence:
(DNA)
                                                          (SEQ ID NO: 509)
actatctcctccggggggacgtacatctactaccccgacagtgtgaaagga (amino acids)
                                                          (SEQ ID NO: 510)
TISSGGTYIYYPDSVKG Mouse C8 heavy chain variable complementarity determining region 3 (CDR3)
sequence:
(DNA)
                                                          (SEQ ID NO: 511)
ctgggcggcgacaattactatgagtat (amino acids)
                                                          (SEQ ID NO: 512)
LGGDNYYEY Humanized C8 heavy chain variable region sequence from IGHV3-21*04:
(DNA)
                                                          (SEQ ID NO: 525)
gaggtgcagctggtggagtctggggga ggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccctgactcagtgaagggccgattcaccatctccagagacaacgccaagaac tcactgtatctgcaaatgaacagcctgagagccgaggacacggccgtgtattactgtgcgagactgggcggcgataa ctattatgaatattggggcaaagggaccacggtcaccgtctcctcc (amino acids)
                                                          (SEQ ID NO: 526)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYWGKGTTVTVSS

Humanized C8 heavy chain variable framework region 1 (FWR1) sequence:
(DNA)
                                                          (SEQ ID NO: 527)
gaggtgcagctggtggagtctggggga ggcctggtcaagcctggggggtccctgagactctcctgtgcagcctctgg attcaccttcagt (amino acids)
                                                          (SEQ ID NO: 528)
EVQLVESGGGLVKPGGSLRLSCAASGFTFS Humanized C8 heavy chain variable complementarity determining region 1 (CDR1)
sequence:
(DNA)
                                                          (SEQ ID NO: 529)
ggctatgccatgagc (amino acids)
                                                          (SEQ ID NO: 530)
GYAMS -continued Humanized C8 heavy chain variable framework region 2 (FWR2) sequence:
(DNA)

(SEQ ID NO: 531)

tgggtccgccaggctccagggaaggggctggagtgggtctca (amino acids)

(SEQ ID NO: 532)

WVRQAPGKGLEWVS

Humanized C8 heavy chain variable complementarity determining region 2 (CDR2)
sequence:
(DNA)

(SEQ ID NO: 533)

accattagtagtggcggaacctacatatactaccctgactcagtgaagggc (amino acids)

(SEQ ID NO: 534)

TISSGGTYIYYPDSVKG

Humanized C8 heavy chain variable framework region 3 (FWR3) sequence:
(DNA)

(SEQ ID NO: 535)

cgattcaccatctccagagacaacgccaagaactcactgtatctgcaaatgaacagcctgagagccgaggacacggc cgtgtattactgtgcgaga (amino acids)

(SEQ ID NO: 536)

RFTISRDNAKNSLYLQMNSLRAEDTAVYYCAR

Humanized C8 heavy chain variable complementarity determining region 3 (CDR3)
sequence:
(DNA)

(SEQ ID NO: 537)

ctgggcggcgataactattatgaatat (amino acids)

(SEQ ID NO: 538)

LGGDNYYEY

Humanized C8 IgG1 heavy chain sequence
(DNA)

(SEQ ID NO: 539)

gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccctgactcagtgaagggccgattcaccatctccagagacaacgccaagaac tcactgtatctgcaaatgaacagcctgagagccgaggacacggccgtgtattactgtgcgagactgggcggcgataa ctattatgaatattggggcaaagggaccacggtcaccgtctcctccgctagcaccaagggcccatcggtcttccccc tggcaccctcctccaagagcacctctgggggcacagcggccctgggctgcctggtcaaggactacttccccgaaccg gtgacggtgtcgtggaactcaggcgccctgaccagcggcgtgcacaccttcccggctgtcctacagtcctcaggact ctactccctcagcagcgtggtgacagtgccctccagcagcttgggcacccagacctacatctgcaacgtgaatcaca agcccagcaacaccaaggtggacaagaaagttgagcccaaatcttgtgacaaaactcacacatgcccaccgtgccca gcacctgaactcctggggggaccgtcagtcttcctcttccccccaaaacccaaggacaccctcatgatctcccggac ccctgaggtcacatgcgtggtggtggacgtgagccacgaagaccctgaggtcaagttcaactggtacgtggacggcg tggaggtgcataatgccaagacaaagccgcgggaggagcagtacaacagcacgtaccgtgtggtcagcgtcctcacc gtcctgcaccaggactggctgaatggcaaggagtacaagtgcaaggtctccaacaaagccctcccagcccccatcga gaaaaccatctccaaagccaaagggcagccccgagaaccacaggtgtacaccctgcccccatcccgggaggagatga ccaagaaccaggtcagcctgacctgcctggtcaaaggcttctatcccagcgacatcgccgtggagtgggagagcaat gggcagccggagaacaactacaagaccacgcctcccgtgctggactccgacggctccttcttcctctacagcaagct caccgtggacaagagcaggtggcagcaggggaacgtcttctcatgctccgtgatgcatgaggctctgcacaaccact acacgcagaagagcctctccctgtctccgggtaaatgataa -continued (amino acids)

(SEQ ID NO: 540)

EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYWGKGTTVTVSSASTKGPSVFPLAPSSKSTSGGTAALGCLVKDYFPEP

VTVSWNSGALTSGVHTFPAVLQSSGLYSLSSVVTVPSSSLGTQTYICNVNHKPSNTKVDKKVEPKSCDKTHTCPPCP

APELLGGPSVFLEPPKPKDTLMISRTPEVTCVVVDVSHEDPEVKFNWYVDGVEVHNAKTKPREEQYNSTYRVVSVLT

VLHQDWLNGKEYKCKVSNKALPAPIEKTISKAKGQPREPQVYTLPPSREEMTKNQVSLTCLVKGFYPSDIAVEWESN

GQPENNYKTTPPVLDSDGSFFLYSKLTVDKSRWQQGNVFSCSVMHEALHNHYTQKSLSLSPGK**

Humanized C8 IgG2 heavy chain sequence
(DNA)

(SEQ ID NO: 541)

gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccctgactcagtgaagggccgattcaccatctccagagacaacgccaagaac tcactgtatctgcaaatgaacagcctgagagccgaggacacggccgtgtattactgtgcgagactgggcggcgataa ctattatgaatattggggcaaagggaccacggtcaccgtctcctccgcctccaccaagggcccatcggtcttccccc tggcgccctgctccaggagcacctccgagagcacagccgccctgggctgcctggtcaaggactacttccccgaaccg gtgacggtgtcgtggaactcaggcgctctgaccagcggcgtgcacaccttcccagctgtcctacagtcctcaggact ctactccctcagcagcgtggtgaccgtgccctccagcaacttcggcacccagacctacacctgcaacgtagatcaca agcccagcaacaccaaggtggacaagacagttgagcgcaaatgttgtgtcgagtgcccaccgtgcccagcaccacct gtggcaggaccgtcagtcttcctcttccccccaaaacccaaggacaccctcatgatctcccggacccctgaggtcac gtgcgtggtggtggacgtgagccacgaagaccccgaggtccagttcaactggtacgtggacggcgtggaggtgcata atgccaagacaaagccacgggaggagcagttcaacagcacgttccgtgtggtcagcgtcctcaccgttgtgcaccag gactggctgaacggcaaggagtacaagtgcaaggtctccaacaaaggcctcccagcccccatcgagaaaaccatctc caaaaccaaagggcagccccgagaaccacaggtgtacaccctgcccccatcccgggaggagatgaccaagaaccagg tcagcctgacctgcctggtcaaaggcttctaccccagcgacatcgccgtggagtgggagagcaatgggcagccggag aacaactacaagaccacacctcccatgctggactccgacggctccttcttcctctacagcaagctcaccgtggacaa gagcaggtggcagcaggggaacgtcttctcatgctccgtgatgcatgaggctctgcacaaccactacacgcagaaga gcctctccctgtctccgggtaaatagtaa (amino acids)

(SEQ ID NO: 542)

EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYWGKGTTVTVSSASTKGPSVFPLAPCSRSTSESTAALGCLVKDYFPEP

VTVSWNSGALTSGVHTFPAVLQSSGLYSLSSVVTVPSSNFGTQTYTCNVDHKPSNTKVDKTVERKCCVECPPCPAPP

VAGPSVFLEPPKPKDTLMISRTPEVTCVVVDVSHEDPEVQFNWYVDGVEVHNAKTKPREEQFNSTFRVVSVLTVVHQ

DWLNGKEYKCKVSNKGLPAPIEKTISKTKGQPREPQVYTLPPSREEMTKNQVSLTCLVKGFYPSDIAVEWESNGQPE

NNYKTTPPMLDSDGSFFLYSKLTVDKSRWQQGNVFSCSVMHEALHNHYTQKSLSLSPGK**

Mouse C8 light chain variable region sequence
(DNA)

(SEQ ID NO: 543)

gacatcgtcattacgcagacccctgccagtcttgccgtttctctgggccagagggccactatcagttacagggcgag taagtctgtgagtaccagcggctatagttacatgcattggaaccagcagaaaccgggacagccaccacgcctgctta tttatctggtgtctaatcttgagtccggggtgcccgccaggttcagcggcagcggctctgggaccgacttcacactc aacattcatccagtggaagaagaggacgctgctacatactactgtcaacacattcgggaactgaccaggagtgaa -continued (amino acids)

(SEQ ID NO: 544)

DIVITQTPASLAVSLGQRATISYRASKSVSTSGYSYMHWNQQKPGQPPRLLIYLVSNLESGVPARFSGSGSGTDFTL

NIHPVEEEDAATYYCQHIRELTRSE

Mouse C8 light chain variable complementarity determining region 1 (CDR1)
sequence:
(DNA)

(SEQ ID NO: 545)

agggcgagtaagtctgtgagtaccagcggctatagttacatgcat (amino acids)

(SEQ ID NO: 546)

RASKSVSTSGYSYMH

Mouse C8 light chain variable complementarity determining region 2 (CDR2)
sequence:
(DNA)

(SEQ ID NO: 547)

ctggtgtctaatcttgagtcc (amino acids)

(SEQ ID NO: 548)

LVSNLES

Mouse C8 light chain variable complementarity determining region 3 (CDR3)
sequence:
(DNA)

(SEQ ID NO: 549)

caacacattcgggaactgaccaggagtgaa (amino acids)

(SEQ ID NO: 550)

QHIRELTRSE

Humanized C8 light chain variable region sequence from NCBI germline z00023:
(DNA)

(SEQ ID NO: 565)

gacatcgtgatgacccagtctccagactccctggctgtgtctctgggcgagagggccaccatcaactgcagggccag caagagtgttagcaccagcggctacagctacatgcactggtaccagcagaaaccaggacagcctcctaagctgctca tttacctggtgtctaacctggaatccggggtccctgaccgattcagtggcagcgggtctgggacagatttcactctc accatcagcagcctgcaggctgaagatgtggcagtttattactgtcaacacattcgggaactgaccaggagtgaatt cggcggagggaccaaggtggagatcaaacgaact (amino acids)

(SEQ ID NO: 566)

DIVMTQSPDSLAVSLGERATINCRASKSVSTSGYSYMHWYQQKPGQPPKLLIYLVSNLESGVPDRFSGSGSGTDFTL

TISSLQAEDVAVYYCQHIRELTRSEFGGGTKVEIKRT

Humanized C8 light chain variable framework region 1 (FWR1) sequence:
(DNA)

(SEQ ID NO: 567)

gacatcgtgatgacccagtctccagactccctggctgtgtctctgggcgagagggccaccatcaactgc (amino acids)

(SEQ ID NO: 568)

DIVMTQSPDSLAVSLGERATINC

Humanized C8 light chain variable complementarity determining region 1 (CDR1)
sequence:
(DNA)

(SEQ ID NO: 569)

agggccagcaagagtgttagcaccagcggctacagctacatg (amino acids)

(SEQ ID NO: 570)

RASKSVSTSGYSYM

Humanized C8 light chain variable framework region 2 (FWR2) sequence:
(DNA)

(SEQ ID NO: 571)

cactggtaccagcagaaaccaggacagcctcctaagctgctcatttac

-continued (amino acids)

(SEQ ID NO: 572)

HWYQQKPGQPPKLLIY

Humanized C8 light chain variable complementarity determining region 2 (CDR2)
sequence:
(DNA)

(SEQ ID NO: 573)

ctggtgtctaacctggaatcc (amino acids)

(SEQ ID NO: 574)

LVSNLES

Humanized C8 light chain variable framework region 3 (FWR3) sequence:
(DNA)

(SEQ ID NO: 575)

ggggtccctgaccgattcagtggcagcgggtctgggacagatttcactctcaccatcagcagcctgcaggctgaaga tgtggcagtttattactgt (amino acids)

(SEQ ID NO: 576)

GVPDRFSGSGSGTDFTLTISSLQAEDVAVYYC

Humanized C8 light chain variable complementarity determining region 3 (CDR3)
sequence:
(DNA)

(SEQ ID NO: 577)

caacacattcgggaactgaccaggagtgaa (amino acids)

(SEQ ID NO: 578)

QHIRELTRSE

Humanized C8 Lambda light chain sequence
(DNA)

(SEQ ID NO: 579)

gacatcgtgatgacccagtctccagactccctggctgtgtctctgggcgagagggccaccatcaactgcagggccag caagagtgttagcaccagcggctacagctacatgcactggtaccagcagaaaccaggacagcctcctaagctgctca tttacctggtgtctaacctggaatccggggtccctgaccgattcagtggcagcgggtctgggacagatttcactctc accatcagcagcctgcaggctgaagatgtggcagtttattactgtcaacacattcgggaactgaccaggagtgaatt cggcggagggaccaaggtggagatcaaacgaactggtcagcccaaggctgcccctcggtcactctgttcccgccct cctctgaggagcttcaagccaacaaggccacactggtgtgtctcataagtgacttctacccgggagccgtgacagtg gcctggaaggcagatagcagccccgtcaaggcgggagtggagaccaccacaccctccaaacaaagcaacaacaagta cgcggccagcagctatctgagcctgacgcctgagcagtggaagtcccacagaagctacagctgccaggtcacgcatg aagggagcaccgtggagaagacagtggcccctacagaatgttcatagtaa (amino acids)

(SEQ ID NO: 580)

DIVMTQSPDSLAVSLGERATINCRASKSVSTSGYSYMHWYQQKPGQPPKLLIYLVSNLESGVPDRFSGSGSGTDFTL

TISSLQAEDVAVYYCQHIRELTRSEFGGGTKVEIKRTGQPKAAPSVTLEPPSSEELQANKATLVCLISDFYPGAVTV

AWKADSSPVKAGVETTTPSKQSNNKYAASSYLSLTPEQWKSHRSYSCQVTHEGSTVEKTVAPTECS**

Humanized C8 Kappa light chain sequence
(DNA)

(SEQ ID NO: 581)

gacatcgtgatgacccagtctccagactccctggctgtgtctctgggcgagagggccaccatcaactgcagggccag caagagtgttagcaccagcggctacagctacatgcactggtaccagcagaaaccaggacagcctcctaagctgctca tttacctggtgtctaacctggaatccggggtccctgaccgattcagtggcagcgggtctgggacagatttcactctc accatcagcagcctgcaggctgaagatgtggcagtttattactgtcaacacattcgggaactgaccaggagtgaatt cggcggagggaccaaggtggagatcaaacgaactacggtggctgcaccatctgtcttcatcttcccgccatctgatg agcagttgaaatctggaactgcctctgttgtgtgcctgctgaataacttctatcccagagaggccaaagtacagtgg aaggtggataacgccctccaatcgggtaactcccaggagagtgtcacagagcaggacagcaaggacagcacctacag -continued cctcagcagcaccctgacgctgagcaaagcagactacgagaaacacaaagtctacgcctgcgaagtcacccatcagg gcctgagctcgcccgtcacaaagagcttcaacaggggagagtgttagtaa (amino acids)

(SEQ ID NO: 582)

DIVMTQSPDSLAVSLGERATINCRASKSVSTSGYSYMHWYQQKPGQPPKLLIYLVSNLESGVPDRFSGSGSGTDFTL

TISSLQAEDVAVYYCQHIRELTRSEFGGGTKVEIKRTTVAAPSVFIFPPSDEQLKSGTASVVCLLNNEYPREAKVQW

KVDNALQSGNSQESVTEQDSKDSTYSLSSTLTLSKADYEKHKVYACEVTHQGLSSPVTKSENRGEC**

CAR-T E6 CD8 sequence:
(DNA)

(SEQ ID NO: 584)

gaggtccagctggttgagagtggcggtgggctggttaagcctggcggctccctgcggctgagctgcgccgcgagtgg atttactttcagccgatatgggatgagttgggtgcggcaagctcccgggaagaggctggaatgggtctcaacaatct ccggggggggcacttacatctattaccccgactcagtcaaggggagatttaccatttcacgagacaacgctaagaat accctgtatttgcagatgaattctctgagagcagaggacacagctgtttactattgtacccgcgacaactatggcag gaactacgactacggtatggactattggggacaagggacattggttacagtgagcagtggcggcgggggcagcggag gaggaggcagcggtggggggggcagcgagatagtgctcacgcagtcacccgcgactctcagtctctcacctggggaa cgagctaccctgacgtgctctgctacctcctcagtgtcatatattcactggtatcagcaacggcccgggcagtcccc tagattgctcatttatagtacctctaatctggcctcaggtatccctgcacgattttctggatctggttcaggttctg attacaccctcactatctctagcctggagcctgaagactttgccgtttattactgccagcagaggtctagctcccca ttcacctttgggagtgggaccaaggttgaaattaaaacgacaacccggcccccagaccaccaacgccagcccccac catcgccagccaacccctgtctctgagaccagaagcctgtaggcctgccgccggtggagctgtgcacacaagaggac tggatttcgcctgtgatatctacatttgggccccgctcgcaggcacatgtggagtgctcctcctctccctggtgatt accctgtactgctgataa (amino acids)

(SEQ ID NO: 585)

EVQLVESGGGLVKPGGSLRLSCAASGFTFSRYGMSWVRQAPGKRLEWVSTISGGGTYIYYPDSVKGRFTISRDNAKN

TLYLQMNSLRAEDTAVYYCTRDNYGRNYDYGMDYWGQGTLVTVSSGGGGSGGGGSGGGGSEIVLTQSPATLSLSPGE

RATLTCSATSSVSYIHWYQQRPGQSPRLLIYSTSNLASGIPARFSGSGSGSDYTLTISSLEPEDFAVYYCQQRSSSP

FTEGSGTKVEIKTTTPAPRPPTPAPTIASQPLSLRPEACRPAAGGAVHTRGLDFACDIYIWAPLAGTCGVLLLSLVI

TLYC**

CAR-T C2 CD8 CD8 sequence:
N-CD81s-huMNC2scFv-CD8ecd fragment- CDB transmembrane-C
(DNA)

(SEQ ID NO: 586)

gaagtgcagctcgtagagagtggcggggggactggtgaagcccggtggaagcctcagactcagttgcgccgcctcagg tttcactttttcaggttacgccatgtcctgggtaagacaggcaccggggaaaggactcgagtgggtgtctactatca gctcaggaggcacttatatatattatcctgactctgtaaaaggccgatttacgatttctcgcgacaatgcaaagaac tccctctacctccaaatgaacagtcttagggcagaagacactgctgtatactattgtgcacgcctcggcggcgacaa ctactacgagtactttgacgtgtggggggaaagggactaccgtgacagtttcaagcggaggaggtggctcaggtggag gcgggtcaggggggggaggaagtgatattgtgctcacacaatccccagcctccctggctgtgtctcccggccaacgc gctacaattacatgtcgggcctccaaaagcgtgagcaccagcggctacagctacatgcactggtatcaacagaaacc aggacaaccccccaaactgttgatttatctcgcttcaaacttggagtccggcgtgcctgcgcgcttttcagggagtg ggagcggcacagattttacgctgactatcaaccccgtagaagcaaacgatacagcgaattattattgtcaacattcc -continued cgggaactcccctttacgttcggcgggggcacaaaggtcgaaattaagagaaccacgacaacccccggccccagacc accaacgccagcccccaccatcgccagccaacccctgtctctgagaccagaagcctgtaggcctgccgccggtggag ctgtgcacacaagaggactggatttcgcctgtgatatctacatttgggccccgctcgcaggcacatgtggagtgctc ctcctctccctggtgattaccctgtactgctgataa (amino acids)
                                                                                    (SEQ ID NO: 587)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSGGGGSGGGGSGGGGSDIVLTQSPASLAVSPGQR

ATITCRASKSVSTSGYSYMHWYQQKPGQPPKLLIYLASNLESGVPARFSGSGSGTDFTLTINPVEANDTANYYCQHS

RELPFTEGGGTKVEIKRTTTTPAPRPPTPAPTIASQPLSLRPEACRPAAGGAVHTRGLDFACDIYIWAPLAGTCGVL

LLSLVITLYC**

CD8/4-1BB sequence
N- CD8 transmembrane- 4-1BB-C
(DNA)
                                                                                    (SEQ ID NO: 588)
acgacaaccccggccccagaccaccaacgccagcccccaccatcgccagccaacccctgtctctgagaccagaagc ctgtaggcctgccgccggtggagctgtgcacacaagaggactggatttcgcctgtgatatctacatttgggccccgc tcgcaggcacatgtggagtgctcctcctctccctggtgattaccctgtactgcaaaaggggccgcaaaaaactcctt tacatttttaagcagcctttttatgaggccagtacagacgactcaagaggaagacgggtgctcatgccgctttcctga ggaggaggaaggagggtgcgaactgtgataa (amino acids)
                                                                                    (SEQ ID NO: 589)
TTTPAPRPPTPAPTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCEL**

CD8/CD28 sequence
N- CD8 transmembrane-CD28-C
(DNA)
                                                                                    (SEQ ID NO: 590)
acgacaaccccggccccagaccaccaacgccagcccccaccatcgccagccaacccctgtctctgagaccagaagc ctgtaggcctgccgccggtggagctgtgcacacaagaggactggatttcgcctgtgatatctacatttgggccccgc tcgcaggcacatgtggagtgctcctcctctccctggtgattaccctgtactgcagaagcaagcggtctcggctcctg cattctgattacatgaacatgaccccaagaagaccaggccccaccaggaaacattaccagccctacgctccgccacg cgacttcgctgcctaccggtcctgataa (amino acids)
                                                                                    (SEQ ID NO: 591)
TTTPAPRPPTPAPTIASQPLSLRPEACRPAAGGAVHTRGLDFACDIYIWAPLAGTCGVLLLSLVITLYCRSKRSRLL

HSDYMNMTPRRPGPTRKHYQPYAPPRDFAAYRS**

CD8/CD3z sequence:
N- CDB transmembrane-CD3zeta-C
(DNA)
                                                                                    (SEQ ID NO: 592)
acgacaaccccggccccagaccaccaacgccagcccccaccatcgccagccaacccctgtctctgagaccagaagc ctgtaggcctgccgccggtggagctgtgcacacaagaggactggatttcgcctgtgatatctacatttgggccccgc tcgcaggcacatgtggagtgctcctcctctccctggtgattaccctgtactgccgcgttaagttctcccgatcagcc gacgcgcctgcttacaagcagggccagaaccaactgtacaacgagctgaatctcggtagacgggaagagtacgacgt gttggacaaacggagaggccgcgacccagaaatgggcggcaagcctcgcaggaaaaacccccaggagggactgtaca atgagttgcagaaagataagatggcagaagcttatagcgagatcggaatgaaggggggaaaggagacgagggaaagga cacgacggcctttatcagggcctgtccacagcaacaaaagatacgtatgacgccctccatatgcaggcacttccacc acggtgataa -continued (amino acids)

(SEQ ID NO: 593)

TTTPAPRPPTPAPTIASQPLSLRPEACRPAAGGAVHTRGLDFACDIYIWAPLAGTCGVLLLSLVITLYCRVKFSRSA

DAPAYKQGQNQLYNELNLGRREEYDVLDKRRGRDPEMGGKPRRKNPQEGLYNELQKDKMAEAYSEIGMKGERRRGKG

HDGLYQGLSTATKDTYDALHMQALPPR**

CD8/CD28/CD3z sequence:
N- CD8 transmembrane- CD28- CD3zeta-C
(DNA)

(SEQ ID NO: 594)

acgacaaccccggcccccagaccaccaacgccagcccccaccatcgccagccaacccctgtctctgagaccagaagc ctgtaggcctgccgccggtggagctgtgcacacaagaggactggatttcgcctgtgatatctacatttgggccccgc tcgcaggcacatgtggagtgctcctcctctccctggtgattaccctgtactgcagaagcaagcggtctcggctcctg cattctgattacatgaacatgaccccaagaagaccaggccccaccaggaaacattaccagccctacgctccgccacg cgacttcgctgcctaccggtcccgcgttaagttctcccgatcagccgacgcgcctgcttacaagcagggccagaacc aactgtacaacgagctgaatctcggtagacgggaagagtacgacgtgttggacaaacggagaggccgcgacccagaa atgggcggcaagcctcgcaggaaaaaccccagagggactgtacaatgagttgcagaaagataagatggcagaagc ttatagcgagatcggaatgaaggggggaaggagacgagggaaaggacacgacggcctttatcagggcctgtccacag caacaaaagatacgtatgacgccctccatatgcaggcacttccaccacggtgataa (amino acids)

(SEQ ID NO: 595)

TTTPAPRPPTPAPTIASQPLSLRPEACRPAAGGAVHTRGLDFACDIYIWAPLAGTCGVLLLSLVITLYCRSKRSRLL

HSDYMNMTPRRPGPTRKHYQPYAPPRDFAAYRSRVKFSRSADAPAYKQGQNQLYNELNLGRREEYDVLDKRRGRDPE

MGGKPRRKNPQEGLYNELQKDKMAEAYSEIGMKGERRRGKGHDGLYQGLSTATKDTYDALHMQALPPR**

CD8/4-1BB/CD3z sequence:
N- CD8 transmembrane- 4-1BB- CD3zeta-C
(DNA)

(SEQ ID NO: 596)

acgacaaccccggcccccagaccaccaacgccagcccccaccatcgccagccaacccctgtctctgagaccagaagc ctgtaggcctgccgccggtggagctgtgcacacaagaggactggatttcgcctgtgatatctacatttgggccccgc tcgcaggcacatgtggagtgctcctcctctccctggtgattaccctgtactgcaaaaggggccgcaaaaaactcctt tacatttttaagcagccttttatgaggccagtacagacgactcaagaggaagacgggtgctcatgccgctttcctga ggaggaggaaggagggtgcgaactgcgcgttaagttctcccgatcagccgacgcgcctgcttacaagcagggccaga accaactgtacaacgagctgaatctcggtagacgggaagagtacgacgtgttggacaaacggagaggccgcgacccca gaaatgggcggcaagcctcgcaggaaaaaccccaggagggactgtacaatgagttgcagaaagataagatggcaga agcttatagcgagatcggaatgaaggggggaaggagacgagggaaaggacacgacggcctttatcagggcctgtcca cagcaacaaaagatacgtatgacgccctccatatgcaggcacttccaccacggtgataa (amino acids)

(SEQ ID NO: 597)

TTTPAPRPPTPAPTIASQPLSLRPEACRPAAGGAVHTRGLDFACDIYIWAPLAGTCGVLLLSLVITLYCKRGRKKLL

YIFKQPFMRPVQTTQEEDGCSCRFPEEEEGGCELRVKFSRSADAPAYKQGQNQLYNELNLGRREEYDVLDKRRGRDP

EMGGKPRRKNPQEGLYNELQKDKMAEAYSEIGMKGERRRGKGHDGLYQGLSTATKDTYDALHMQALPPR**

CD8/CD28/4-1BB/CD3z sequence:
N- CD8 transmembrane-CD28- 4-1BB-CD3zeta-C
(DNA)

(SEQ ID NO: 598)

acgacaaccccggcccccagaccaccaacgccagcccccaccatcgccagccaacccctgtctctgagaccagaagc ctgtaggcctgccgccggtggagctgtgcacacaagaggactggatttcgcctgtgatatctacatttgggccccgc tcgcaggcacatgtggagtgctcctcctctccctggtgattaccctgtactgcagaagcaagcggtctcggctcctg cattctgattacatgaacatgaccccaagaagaccaggccccaccaggaaacattaccagccctacgctccgccacg cgacttcgctgcctaccggtccaaaaggggccgcaaaaaactcctttacatttttaagcagccttttatgaggccag -continued

```
tacagacgactcaagaggaagacgggtgctcatgccgctttcctgaggaggaggaaggagggtgcgaactgcgcgtt aagttctcccgatcagccgacgcgcctgcttacaagcagggccagaaccaactgtacaacgagctgaatctcggtag acgggaagagtacgacgtgttggacaaacggagaggccgcgacccagaaatgggcggcaagcctcgcaggaaaaacc cccaggagggactgtacaatgagttgcagaaagataagatggcagaagcttatagcgagatcggaatgaaggggggaa aggagacgagggaaaggacacgacggcctttatcagggcctgtccacagcaacaaaagatacgtatgacgccctcca tatgcaggcacttccaccacggtgataa
```

(amino acids)

<div align="right">(SEQ ID NO: 599)</div>

```
TTTPAPRPPTPAPTIASQPLSLRPEACRPAAGGAVHTRGLDFACDIYIWAPLAGTCGVLLLSLVITLYCRSKRSRLL

HSDYMNMTPRRPGPTRKHYQPYAPPRDFAAYRSKRGRKKLLYIFKQPFMRPVQTTQEEDGCSCRFPEEEEGGCELRV

KFSRSADAPAYKQGQNQLYNELNLGRREEYDVLDKRRGRDPEMGGKPRRKNPQEGLYNELQKDKMAEAYSEIGMKGE

RRRGKGHDGLYQGLSTATKDTYDALHMQALPPR**
```

CAR-T C2 CD8/CD8/CD28/CD3z sequence:
N-CD81s-huMNC2scFv-CD8ecd fragment- CDB transmembrane- CD28- CD3zeta-C
(DNA)

<div align="right">(SEQ ID NO: 608)</div>

```
atggccttgccagtgacggccctgctgctgccattggctcttctgttgcacgctgccaggcctgaagtgcagctcgt agagagtggcgggggactggtgaagcccggtggaagcctcagactcagttgcgccgcctcaggtttcactttttcag gttacgccatgtcctgggtaagacaggcaccggggaaaggactcgagtgggtgtctactatcagctcaggaggcact tatatatattatcctgactctgtaaaaggccgatttacgatttctcgcgacaatgcaaagaactccctctacctcca aatgaacagtcttagggcagaagacactgctgtatactattgtgcacgcctcggcggcgacaactactacgagtact ttgacgtgtggggggaaaggggactaccgtgacagtttcaagcggaggaggtggctcaggtggaggcgggtcagggggg ggaggaagtgatattgtgctcacacaatcccagcctccctggctgtgtctcccggccaacgcgctacaattacatg tcgggcctccaaaagcgtgagcaccagcggctacagctacatgcactggtatcaacagaaaccaggacaacccccca aactgttgatttatctcgcttcaaacttggagtccggcgtgcctgcgcgcttttcagggagtgggagcggcacagat tttacgctgactatcaaccccgtagaagcaaacgatacagcgaattattattgtcaacattcccgggaactcccctt tacgttcggcggggcacaaaggtcgaaattaagagagaaccacgacaaccccggcccccagaccaccaacgccagccc ccaccatcgccagccaaccccctgtctctgagaccagaagcctgtaggcctgccgccggtggagctgtgcacacaaga ggactggatttcgcctgtgatatctacatttgggcccgctcgcaggcacatgtggagtgctcctcctctccctggt gattaccctgtactgcagaagcaagcggtctcggctcctgcattctgattacatgaacatgaccccaagaagaccag gccccaccaggaaacattaccagccctacgctccgccacgcgacttcgctgcctaccggtcccgcgttaagttctcc cgatcagccgacgcgcctgcttacaagcagggccagaaccaactgtacaacgagctgaatctcggtagacgggaaga gtacgacgtgttggacaaacggagaggccgcgacccagaaatgggcggcaagcctcgcaggaaaaacccccaggagg gactgtacaatgagttgcagaaagataagatggcagaagcttatagcgagatcggaatgaaggggggaaaggagacga gggaaaggacacgacggcctttatcagggcctgtccacagcaacaaaagatacgtatgacgccctccatatgcaggc acttccaccacggtgataa
```

(amino acids)

<div align="right">(SEQ ID NO: 609)</div>

```
MALPVTALLLPLALLLHAARPEVQLVESGGGLVKPGGSLRLSCAASGFTFSGYAMSWVRQAPGKGLEWVSTISSGGT

YIYYPDSVKGRFTISRDNAKNSLYLQMNSLRAEDTAVYYCARLGGDNYYEYFDVWGKGTTVTVSSGGGGSGGGGSGG

GGSDIVLTQSPASLAVSPGQRATITCRASKSVSTSGYSYMHWYQQKPGQPPKLLIYLASNLESGVPARFSGSGSGTD

FTLTINPVEANDTANYYCQHSRELPFTEGGGTKVEIKRTTTTPAPRPPTPAPTIASQPLSLRPEACRPAAGGAVHTR
```

-continued

GLDFACDIYIWAPLAGTCGVLLLSLVITLYCRSKRSRLLHSDYMNMTPRRPGPTRKHYQPYAPPRDFAAYRSRVKFS

RSADAPAYKQGQNQLYNELNLGRREEYDVLDKRRGRDPEMGGKPRRKNPQEGLYNELQKDKMAEAYSEIGMKGERRR

GKGHDGLYQGLSTATKDTYDALHMQALPPR**

CAR-T C2 CD8/CD8/4-1BB/CD3z sequence #13:
N-CD81s-huMNC2scFv-CD8ecd fragment- CDB transmembrane- 4-1BB- CD3zeta-C
(DNA)
                                                                            (SEQ ID NO: 610)
atggccttgccagtgacggccctgctgctgccattggctcttctgttgcacgctgccaggcctgaagtgcagctcgt agagagtggcgggggactggtgaagcccggtggaagcctcagactcagttgcgccgcctcaggtttcactttttcag gttacgccatgtcctgggtaagacaggcaccggggaaaggactcgagtgggtgtctactatcagctcaggaggcact tatatatattatcctgactctgtaaaaggccgatttacgatttctcgcgacaatgcaaagaactccctctacctcca aatgaacagtcttagggcagaagacactgctgtatactattgtgcacgcctcggcggcgacaactactacgagtact ttgacgtgtgggggaaagggactaccgtgacagtttcaagcggaggaggtggctcaggtggaggcgggtcaggggggg ggaggaagtgatattgtgctcacacaatccccagcctccctggctgtgtctcccggccaacgcgctacaattacatg tcgggcctccaaaagcgtgagcaccagcggctacagctacatgcactggtatcaacagaaaccaggacaaccccca aactgttgatttatctcgcttcaaacttggagtccggcgtgcctgcgcgcttttcagggagtgggagcggcacagat tttacgctgactatcaaccccgtagaagcaaacgatacagcgaattattattgtcaacattcccgggaactcccctt tacgttcggcgggggcacaaaggtcgaaattaagagaaccacgacaaccccggccccagaccaccaacgccagccc ccaccatcgccagccaaccctgtctctgagaccagaagcctgtaggcctgccgccggtggagctgtgcacacaaga ggactggatttcgcctgtgatatctacatttgggccccgctcgcaggcacatgtggagtgctcctcctctccctggt gattaccctgtactgcaaaaggggccgcaaaaaactcctttacatttttaagcagcctttttatgaggccagtacaga cgactcaagaggaagacgggtgctcatgccgcctttcctgaggaggaggaaggagggtgcgaactgcgcgttaagttc tcccgatcagccgacgcgcctgcttacaagcagggccagaaccaactgtacaacgagctgaatctcggtagacggga agagtacgacgtgttggacaaacggagaggccgcgacccagaaatgggcggcaagcctcgcaggaaaaacccccagg agggactgtacaatgagttgcagaaagataagatggcagaagcttatagcgagatcggaatgaagggggaaaggaga cgagggaaaggacacgacggcctttatcagggcctgtccacagcaacaaaagatacgtatgacgccctccatatgca ggcacttccaccacggtgataa (amino acids)
                                                                            (SEQ ID NO: 611)
MALPVTALLLPLALLLHAARPEVQLVESGGGLVKPGGSLRLSCAASGFTFSGYAMSWVRQAPGKGLEWVSTISSGGT

YIYYPDSVKGRFTISRDNAKNSLYLQMNSLRAEDTAVYYCARLGGDNYYEYEDVWGKGTTVTVSSGGGGSGGGGSGG

GGSDIVLTQSPASLAVSPGQRATITCRASKSVSTSGYSYMHWYQQKPGQPPKLLIYLASNLESGVPARFSGSGSGTD

FTLTINPVEANDTANYYCQHSRELPFTEGGGTKVEIKRTTTTPAPRPPTPAPTIASQPLSLRPEACRPAAGGAVHTR

GLDFACDIYIWAPLAGTCGVLLLSLVITLYCKRGRKKLLYIFKQPFMRPVQTTQEEDGCSCREPEEEEGGCELRVKF

SRSADAPAYKQGQNQLYNELNLGRREEYDVLDKRRGRDPEMGGKPRRKNPQEGLYNELQKDKMAEAYSEIGMKGERR

RGKGHDGLYQGLSTATKDTYDALHMQALPPR**

MUC1 truncated extra cellular domain sequence
(amino acids)
                                                                            (SEQ ID NO: 620)
SNIKFRPGSVVVQLTLAFREGTINVHDVETQFNQYKTEAASRY MUC1 truncated extra cellular domain sequence
(amino acids)
                                                                            (SEQ ID NO: 621)
SVVVQLTLAFREGTINVHDVETQFNQYKTEAASRY MUC1 truncated extra cellular domain sequence
(amino acids)
                                                                            (SEQ ID NO: 622)
VQLTLAFREGTINVHDVETQFNQY -continued MUC1 truncated extra cellular domain sequence
(amino acids)

(SEQ ID NO: 623)

SNIKFRPGSVVVQLTLAFREGTIN

Primers (SEQ ID NO: 624)

attctaagcttgggccaccatggaactg (SEQ ID NO: 625)

tctagagtttaaacttactatttacccggagacagggagag (SEQ ID NO: 626)

agtatggcccagccggccgaggtgcagctggtggagtctgg (SEQ ID NO: 627)

tagaaggcacagtcgaggctgatcag (SEQ ID NO: 628)

attctaagcttgggccaccatggaagc (SEQ ID NO: 629)

tctagagtttaaacttactaacactctcccctgttgaagc (SEQ ID NO: 630)

agtatggcccagccggccgaaattgtgttgacacagtctccag (SEQ ID NO: 631)

tagaaggcacagtcgaggctgatcag (SEQ ID NO: 632)

actgtcatatggaggtgcagctggtggagtctg (SEQ ID NO: 633)

actgtctcgagtttaatttccactttggtgccgctgc (SEQ ID NO: 634)

actgtcatatggaggtgcagctggtggagtctg (SEQ ID NO: 635)

actgtaccggttttaatttccactttggtgccgctgc (SEQ ID NO: 636)

cttcttcctcaggagcaagctcaccgtgg (SEQ ID NO: 637)

gagccgtcggagtccagc (SEQ ID NO: 638)

gcacctgaactcctgggg (SEQ ID NO: 639)

tttaatttccactttggtgccg (SEQ ID NO: 640)

cgcggctagcttaagcttggtaccgagggcca (SEQ ID NO: 641)

cgcggcggccgcctgatcagcgggtttaaacttatc

MMP9
(DNA (SEQ ID NO: 642)

atgagcctctggcagcccctggtcctggtgctcctggtgctgggctgctgctttgctgcccccagacagcgccagtc caccccttgtgctcttccctggagacctgagaaccaatctcaccgacaggcagctggcagaggaatacctgtaccgct atggttacactcgggtggcagagatgcgtggagagtcgaaatctctggggcctgcgctgctgcttctccagaagcaa ctgtccctgcccgagaccggtgagctggatagcgccacgctgaaggccatgcgaaccccacggtgcggggtcccaga cctgggcagattccaaacctttgagggcgacctcaagtggcaccaccacaacatcacctattggatccaaaactact cggaagacttgccgcgggcggtgattgacgacgcctttgcccgcgccttcgcactgtggagcgcggtgacgccgctc accttcactcgcgtgtacagccgggacgcagacatcgtcatccagtttggtgtcgcggagcacggagacgggtatcc cttcgacgggaaggacgggctcctggcacacgcctttcctcctggccccggcattcaggagacgcccatttcgacg atgacgagttgtggtccctgggcaagggcgtcgtggttccaactcggtttggaaacgcagatggcgcggcctgccac ttccccttcatcttcgagggccgctcctactctgcctgcaccaccgacggtcgctccgacggcttgccctggtgcag taccacggccaactacgacaccgacgaccggtttggcttctgccccagcgagagactctacacccaggacggcaatg ctgatgggaaaccctgccagtttccattcatcttccaaggccaatcctactccgcctgcaccacggacggtcgctcc gacggctaccgctggtgcgccaccaccgccaactacgaccgggacaagctcttcggcttctgcccgacccgagctga ctcgacggtgatggggggcaactcggcggggggagctgtgcgtcttccccttcactttcctgggtaaggagtactcga cctgtaccagcgagggccgcgggagatgggcgcctctggtgcgctaccacctcgaactttgacagcgacaagaagtgg ggcttctgcccggaccaaggatacagtttgttcctcgtggcggcgcatgagttcggccacgcgctgggcttagatca ttcctcagtgccggaggcgctcatgtaccctatgtaccgcttcactgaggggcccccccttgcataaggacgacgtga atggcatccggcacctctatggtcctcgccctgaacctgagccacggcctccaaccaccaccacaccgcagcccacg gctcccccgacggtctgccccaccggacccccactgtccacccctcagagcgcccacagctggccccacaggtcc cccctcagctggccccacaggtccccccactgctggcccttctacggccactactgtgcctttgagtccggtggacg atgcctgcaacgtgaacatcttcgacgccatcgcggagattgggaaccagctgtatttgttcaaggatgggaagtac tggcgattctctgagggcagggggagccggccgcagggccccttccttatcgccgacaagtggcccgcgctgccccg caagctggactcggtctttgaggagcggctctccaagaagctttttcttcttctctgggcgccaggtgtgggtgtaca caggcgcgtcggtgctgggcccgaggcgtctggacaagctgggcctgggagccgacgtggcccaggtgaccggggcc ctccggagtggcaggggggaagatgctgctgttcagcgggcggcgcctctggaggttcgacgtgaaggcgcagatggt ggatccccggagcgccagcgaggtggaccggatgttccccgggggtgcctttggacacgcacgacgtcttccagtacc gagagaaagcctatttctgccaggaccgcttctactggcgcgtgagttcccggagtgagttgaaccaggtggaccaa gtgggctacgtgacctatgacatcctgcagtgccctgaggac<u>gattacaaggatgacgacgataagt</u>gataa (amino acids)
                                                                    (SEQ ID NO: 643)
MSLWQPLVLVLLVLGCCFAAPRQRQSTLVLFPGDLRTNLTDRQLAEEYLYRYGYTRVAEMRGESKSLGPALLLLQKQ

LSLPETGELDSATLKAMRTPRCGVPDLGRFQTFEGDLKWHHHNITYWIQNYSEDLPRAVIDDAFARAFALWSAVTPL

TFTRVYSRDADIVIQFGVAEHGDGYPFDGKDGLLAHAFPPGPGIQGDAHFDDDELWSLGKGVVVPTRFGNADGAACH

FPFIFEGRSYSACTTDGRSDGLPWCSTTANYDTDDRFGFCPSERLYTQDGNADGKPCQFPFIFQGQSYSACTTDGRS

DGYRWCATTANYDRDKLFGFCPTRADSTVMGGNSAGELCVFPFTFLGKEYSTCTSEGRGDGRLWCATTSNFDSDKKW

GFCPDQGYSLFLVAAHEFGHALGLDHSSVPEALMYPMYRFTEGPPLHKDDVNGIRHLYGPRPEPEPRPPTTTTPQPT

APPTVCPTGPPTVHPSERPTAGPTGPPSAGPTGPPTAGPSTATTVPLSPVDDACNVNIFDAIAEIGNQLYLFKDGKY

WRFSEGRGSRPQGPFLIADKWPALPRKLDSVFEERLSKKLFFFSGRQVWVYTGASVLGPRRLDKLGLGADVAQVTGA

LRSGRGKMLLFSGRRLWRFDVKAQMVDPRSASEVDRMFPGVPLDTHDVFQYREKAYFCQDRFYWRVSSRSELNQVDQ

VGYVTYDILQCPEDDYKDDDDK**

MMP9 catalytic domain
(DNA)
                                                                    (SEQ ID NO: 644)
atgttccaaacctttgagggcgacctcaagtggcaccaccacaacatcacctattggatccaaaactactcggaaga cttgccgcgggcggtgattgacgacgcctttgcccgcgccttcgcactgtggagcgcggtgacgccgctcaccttca ctcgcgtgtacagccgggacgcagacatcgtcatccagtttggtgtcgcggagcacggagacgggtatcccttcgac gggaaggacgggctcctggcacacgcctttcctcctggccccggcattcaggagacgcccatttcgacgatgacga gttgtggtccctgggcaagggcgtcgtggttccaactcggtttggaaacgcagatggcgcggcctgccacttcccct tcatcttcgagggccgctcctactctgcctgcaccaccgacggtcgctccgacggcttgccctggtgcagtaccacg gccaactacgacaccgacgaccggtttggcttctgccccagcgagagactctacacccaggacggcaatgctgatgg gaaaccctgccagtttccattcatcttccaaggccaatcctactccgcctgcaccacggacggtcgctccgacggct accgctggtgcgccaccaccgccaactacgaccgggacaagctcttcggcttctgcccgacccgagctgactcgacg -continued gtgatgggggcaactcggcggggagctgtgcgtcttcccttcactttcctgggtaaggagtactcgacctgtac cagcgagggccgcggagatgggcgcctctggtgcgctaccacctcgaactttgacagcgacaagaagtgggcttct gcccggaccaaggatacagtttgttcctcgtggcggcgcatgagttcggccacgcgctgggcttagatcattcctca gtgccggaggcgctcatgtaccctatgtaccgcttcactgaggggccccccttgcataaggacgacgtgaatggcat ccggcacctctatggtcctcgccctgaacct<u>gattacaaggatgacgacgataag</u>tgataa (amino acids)

(SEQ ID NO: 645)
MFQTFEGDLKWHHHNITYWIQNYSEDLPRAVIDDAFARAFALWSAVTPLTFTRVYSRDADIVIQFGVAEHGDGYPFD

GKDGLLAHAFPPGPGIQGDAHFDDDELWSLGKGVVVPTRFGNADGAACHFPFIFEGRSYSACTTDGRSDGLPWCSTT

ANYDTDDRFGFCPSERLYTQDGNADGKPCQFPFIFQGQSYSACTTDGRSDGYRWCATTANYDRDKLFGFCPTRADST

VMGGNSAGELCVFPFTFLGKEYSTCTSEGRGDGRLWCATTSNFDSDKKWGFCPDQGYSLFLVAAHEFGHALGLDHSS

VPEALMYPMYRFTEGPPLHKDDVNGIRHLYGPRPEPDYKDDDDK**

NFATc1 Promoter (NFATc1P)
(DNA)

(SEQ ID NO: 646)
aggcaggaggaagaggaaaggggcgcagggcgctcggggagcagagccgggggcccgcggtggccgcagaggccggg ccggggcgcagaggccgggcgagctggccgcgctctgggccgccgcctccggaactccctgcgcctggcgcgcggcc accgtggtcccggcaacggcattaaacagagggaaacagacccgggattccgtcacccgggcggggggataaggacg gctttgagagcagacaggaaaagggagcttttctgcatggggtgaaaaaattatttattgaaggaggaggaggcggc agcggaggaaggggagggcgggaggaggaggaagagccggccgcccccgccccggccccggctcctcaggagccaa gggcagcctcgccaggtcggtcccgggctcgaggaccgcggctggggtcgagggctcagtctcccacgtgaccggc tgggcgcgccccgccagacccggcctcgggattccctcctcccggcgagtctccgcccgccccgtcctggaggtggg gagaaggagggcggggcggggggacggaaactctccccgccaaatcctggccccaggcctggggacactcgcggcg ggaagatttggaggggaggggaggggggaggggcgtggggcgcggcctcgctggagtcccctgacccccgacccc cgcccaccggcctgggcgtcctcccgcggcccctcctccctcccggcgccggtgctctgggcgcgtgccacgcc tggctcggcgccgtaggggcccccgcaggtagagacccctggaaatggcctcgacgccgcaggagcgaggcggccac cacccgctaatccgggcacgtctctccaggccgaggcctgcggtggaaaagccgggggttccatttgtgctgagtcg gggcggccgaatggagccaggcctcgggacgcgggacggacgggctctggccgcgcaccttcgcgggctctgcagcg cccgaccgcctcccccggcagggaggaggcgcttgtgggggggcacccacggggcacagtgatccctgggggtctgcg gacctcctgggcccgcagcagacacgagtttagcctttgggtttagtttaaatcacataagggtgtcgtgcaatcg atttatggtttctacacaccagacactttaacctccaaccccccatccaagccaacaagaaaatgcggtgccgtg ttggcagctgagctgcgcccgaagagacgcagggagacgtaagagaggaaagtgtgagtggccgggggggcctccccc cgtcagaagtcgcgcagtcgcgcccataaaacgcccctccgggcggctagggcaggtgagcgcgtcccggggcctc cccacgccggcccctgccacagagccgtctaggtcgagcagatatttacagaataaaaatgacaataactcgacgtc ccgggacggccacgcaatctgttagtaatttagcgggatgggaatttcctttctagggcctgccagtgaagcgctttt tccaaatttccacagcggggggaagcctgcgattttacataatgacttcagcatgccgggctttctcgacacccctcc ccggcccccggccccgcccccgcccctttccagcagggccgggctccctccggacacccgcgtggactcaggcg tcccgtctggccgttcgcccccgtttccccgccagccccagcgcccccctgcccggcccccggattccccgttcc cgcccctacgcccccatccctccccgtgcgccccctcccgtgcgccccctcccgtgcgcccccctcccgtgc gcccccctcccgtgcgcccccctcccgggcgcccccctcccgggcgcccccctcccgtgcgcccccccctc cccgtgcgcccccctcccgtgcgcgcccgcctcttgcgccctgcccccaggcgagcggctgccgcggcgcggg -continued gaggggcgggcgctcggcgactcgtccccggggccccgcgcgggcccgggcagcaggggcgtgatgtcacggcaggg aggggcgcgggagccgccgggccggcggggaggcggggaggtgttttccagctttaaaaaggcaggaggcagagc gcggccctgcgtcagagcgagactcagagg NFATc1P-MMP9
(DNA)

(SEQ ID NO: 647)

aggcaggaggaagaggaaaggggcgcagggcgctcggggagcagagccgggggcccgcggtggccgcagaggccggg ccggggcgcagaggccgggcgagctggccgcgctctgggccgccgcctccggaactccctgcgcctggcgcgcggcc accgtggtcccggcaacggcattaaacagagggaaacagacccgggattccgtcacccgggcggggggataaggacg gctttgagagcagacaggaaaagggagcttttctgcatggggtgaaaaaattatttattgaaggaggaggaggcggc agcggaggaaggggaggggcgggaggaggaggaagagccggccgcccccgccccggcccggctcctcaggagccaa gggcagcctcgccaggtcggtcccgggctcgaggaccgcggctggggtcgaggggctcagtctcccacgtgaccggc tgggcgcgccccgccagacccggcctcgggattccctcctcccggcgagtctccgcccgccccgtcctggaggtggg gagaaggagggcggggcggggggacggaaactctccccgccaaatcctggccccaggcctggggacactcgcggcg ggaagatttggaggggaggggagggggaggggcgtggggcgcggcctcgctggagtcccctgacccccgacccc cgcccaccggctgggcgtcctcccgcggcccctcctccctcccggcgccggtgctctggggcgcgtgccacgcc tggctcggcgccgtaggggcccccgcaggtagagacccctggaaatggcctcgacgccgcaggagcgaggcggccac cacccgctaatccgggcacgtctctccaggccgaggcctgcggtggaaaagccggggttccatttgtgctgagtcg gggcggccgaatggagccaggcctcgggacgcgggacggacgggctctggccgcgcaccttcgcgggctctgcagcg cccgaccgcctcccccggcaggaggaggcgcttgtggggggcacccacggggcacagtgatccctgggggtctgcg gacctcctgggccccgcagcagacacgagtttagcctttgggtttagtttaaatcacataagggtgtcgtgcaatcg atttatggtttctacacaccagacactttaacctccaacccccccatccaagccaacaagaaaatgcggtgccgtg ttggcagctgagctgcgcccgaagagacgcagggagacgtaagagaggaaagtgtgagtggccgggggggcctccccc cgtcagaagtcgcgcagtcgcgcccataaaacgcccctccgggcggctagggcaggtgagcgcgtccccgggcctc cccacgccggcccctgccacagagccgtctaggtcgagcagatatttacagaataaaaatgacaataactcgacgtc ccgggacggccacgcaatctgttagtaatttagcgggatgggaatttccttttctagggcctgccagtgaagcgcttt tccaaatttccacagcgggggaagcctgcgattttacataatgacttcagcatgccgggctttctcgacacccctcc ccggcccccggcccccgcccccgcccctttttccagcagggccgggctccctccggacaccgcgtggactcaggcg tcccgtctggcccgttcgcccccgtttcccccgccagccccagcgcccccctgcccggccccggattccccgttcc cgccctacgccccatccctccccgtgcgcccctcccccgtgcgccccctccccgtgcgcccccccctcccccgtgc gcccccctccccgtgcgcccccctccccgggcgcccccctccccgggcgcccccctccccgtgcgcccccccctc cccgtgcgcccccctccccgtgcgcgccccgcctcttgcgccctgccccaggcgagcggctgccgcggcgcggg gaggggcgggcgctcggcgactcgtccccggggccccgcgcgggcccgggcagcaggggcgtgatgtcacggcaggg aggggcgcgggagccgccgggccggcggggaggcggggaggtgttttccagctttaaaaaggcaggaggcagagc gcggccctgcgtcagagcgagactcagagg<u>tctaga</u>gccaccatgagcctctggcagcccctggtcctggtgctcct ggtgctgggctgctgctttgctgccccagacagcgccagtccacccttgtgctcttccctggagacctgagaacca atctcaccgacaggcagctggcagaggaatacctgtaccgctatggttacactcgggtggcagagatgcgtggagag tcgaaatctctggggcctgcgctgctgcttctccagaagcaactgtccctgcccgagaccggtgagctggatagcgc cacgctgaaggccatgcgaacccccacggtgcggggtcccagacctgggcagattccaaacctttgagggcgacctca agtggcaccaccacaacatcacctattggatccaaaactactcggaagacttgccgcgggcggtgattgacgacgcc tttgcccgcgccttcgcactgtggagcgcggtgacgccgctcaccttcactcgcgtgtacagccgggacgcagacat cgtcatccagtttggtgtcgcggagcacggagacgggtatcccttcgacgggaaggacgggctcctggcacacgcct -continued

```
ttcctcctggccccggcattcagggagacgcccatttcgacgatgacgagttgtggtccctgggcaagggcgtcgtg gttccaactcggtttggaaacgcagatggcgcggcctgccacttccccttcatcttcgagggccgctcctactctgc ctgcaccaccgacggtcgctccgacggcttgccctggtgcagtaccacggccaactacgacaccgacgaccggtttg gcttctgccccagcgagagactctacacccaggacggcaatgctgatgggaaaccctgccagtttccattcatcttc caaggccaatcctactccgcctgcaccacggacggtcgctccgacggctaccgctggtgcgccaccaccgccaacta cgaccgggacaagctcttcggcttctgcccgacccgagctgactcgacggtgatgggggggcaactcggcgggggagc tgtgcgtcttccccttcactttcctgggtaaggagtactcgacctgtaccagcgagggccgcggagatgggcgcctc tggtgcgctaccacctcgaactttgacagcgacaagaagtggggcttctgcccggaccaaggatacagtttgttcct cgtggcggcgcatgagttcggccacgcgctgggcttagatcattcctcagtgccggaggcgctcatgtaccctatgt accgcttcactgaggggcccccccttgcataaggacgacgtgaatggcatccggcacctctatggtcctcgccctgaa cctgagccacggcctccaaccaccaccacaccgcagcccacggctcccccgacggtctgccccaccggacccccac tgtccacccctcagagcgcccacagctggccccacaggtccccccctcagctggcccacaggtcccccccactgctg gcccttctacggccactactgtgcctttgagtccggtggacgatgcctgcaacgtgaacatcttcgacgccatcgcg gagattgggaaccagctgtatttgttcaaggatgggaagtactggcgattctctgagggcaggggggagccggccgca gggcccccttccttatcgccgacaagtggcccgcgctgccccgcaagctggactcggtctttgaggagcggctctcca agaagctttcttcttctctgggcgccaggtgtgggtgtacacaggcgcgtcggtgctgggcccgaggcgtctggac aagctgggcctgggagccgacgtggcccaggtgaccggggccctccggagtggcaggggggaagatgctgctgttcag cgggcggcgcctctggaggttcgacgtgaaggcgcagatggtggatccccggagcgccagcgaggtggaccggatgt tccccggggtgcctttggacacgcacgacgtcttccagtaccgagagaaagcctatttctgccaggaccgcttctac tggcgcgtgagttcccggagtgagttgaaccaggtggaccaagtgggctacgtgacctatgacatcctgcagtgccc tgaggacgattacaaggatgacgacgataagtgataa
```

NFATc1P-MMP9cat
(DNA)

(SEQ ID NO: 648)

```
aggcaggaggaagaggaaaggggcgcagggcgctcggggagcagagccgggggcccgcggtggccgcagaggccggg ccggggcgcagaggccgggcgagctggccgcgctctgggccgccgcctccggaactccctgcgcctggcgcgcggcc accgtggtcccggcaacggcattaaacagagggaaacagacccgggattccgtcacccgggcgggggggataaggacg gctttgagagcagacaggaaaaggggagctttttctgcatggggtgaaaaaattatttattgaaggaggaggaggcggc agcggaggaaggggagggggcgggaggaggaggaagagccggccgcccccgccccggccccggctcctcaggagccaa gggcagcctcgccaggtcggtcccgggctcgaggaccgcggctggggtcgaggggctcagtctcccacgtgaccggc tgggcgcgccccgccagacccggcctcgggattccctcctcccggcgagtctccgcccgccccgtcctggaggtggg gagaaggaggcggggcggggggacggaaactctccccgccaaatcctggccccaggcctggggacactcgcggcg ggaagatttggaggggagggagggggagggcgtgggggcgcggcctcgctggagtcccctgacccccgacccc cgcccaccggcctgggcgtcctcccgcgggcccctcctccctcccggcgccggtgctctgggggcgcgtgccacgcc tggctcggcgccgtaggggcccccgcaggtagagacccctggaaatggcctcgacgccgcaggagcgaggcggccac cacccgctaatccgggcacgtctctccaggccgaggcctgcggtggaaaagccggggttccatttgtgctgagtcg gggcggccgaatggagccaggcctcgggacgcgggacggacgggctctggccgcgcaccttcgcgggctctgcagcg cccgaccgcctccccggcagggaggaggcgcttgtggggggcacccacggggcacagtgatccctgggggtctgcg gacctcctgggccccgcagcagacacgagtttagcctttgggtttagtttaaatcacataaagggtgtcgtgcaatcg atttatggtttctacacaccagacactttaacctccaaccccccccatccaagccaacaagaaaatgcggtgccgtg ttggcagctgagctgcgcccgaagagacgcagggagacgtaagagaggaaagtgtgagtggccggggggcctccccc cgtcagaagtcgcgcagtcgcgcccataaaacgcccctccgggcggctagggcaggtgagcgcgtccccgggcctc
```

-continued cccacgccggcccctgccacagagccgtctaggtcgagcagatatttacagaataaaaatgacaataactcgacgtc ccgggacggccacgcaatctgttagtaatttagcgggatgggaatttcctttctagggcctgccagtgaagcgcttt tccaaatttccacagcggggggaagcctgcgattttacataatgacttcagcatgccgggctttctcgacacccctcc ccggcccccggcccccgcccccgcccctttccagcagggccgggctccctccggacaccgcgtggactcaggcg tcccgtctggcccgttcgcccccgtttcccccgccagccccagcgcccccctgcccggcccccggattccccgttcc cgccctacgcccccatcccctccccgtgcgcccctccccgtgcgcccccctccccgtgcgcccccctccccgtgc gcccccctccccgtgcgcccccctccccgggcgcccccctccccgggcgcccccctccccgtgcgcccccccctc cccgtgcgcccccctccccgtgcgcgccccgcctcttgcgccctgccccaggcgagcggctgccgcggcgcggg gaggggcgggcgctcggcgactcgtccccggggccccgcgcgggcccgggcagcaggggcgtgatgtcacggcaggg aggggcgcgggagccgccgggccggcggggaggcggggaggtgttttccagctttaaaaaggcaggaggcagagc gcggccctgcgtcagagcgagactcagagg<u>tctaga</u>gccaccatgttccaaacctttgagggcgacctcaagtggca ccaccacaacatcacctattggatccaaaactactcggaagacttgccgcgggcggtgattgacgacgcctttgccc gcgccttcgcactgtggagcgcggtgacgccgctcaccttcactcgcgtgtacagccgggacgcagacatcgtcatc cagtttggtgtcgcggagcacggagacgggtatcccttcgacggggaaggacgggctcctggcacacgcctttcctcc tggccccggcattcagggagacgcccatttcgacgatgacgagttgtggtccctgggcaagggcgtcgtggttccaa ctcggtttggaaacgcagatggcgcggcctgccacttcccccttcatcttcgagggccgctcctactctgcctgcacc accgacggtcgctccgacggcttgccctggtgcagtaccacggccaactacgacaccgacgaccggtttggcttctg ccccagcgagagactctacacccaggacggcaatgctgatgggaaaccctgccagtttccattcatcttccaaggcc aatcctactccgcctgcaccacggacggtcgctccgacggctaccgctggtgcgccaccaccgccaactacgaccgg gacaagctcttcggcttctgcccgacccgagctgactcgacggtgatggggggcaactcggcggggggagctgtgcgt cttccccttcactttcctgggtaaggagtactcgacctgtaccagcgagggccgcggagatgggcgcctctggtgcg ctaccacctcgaactttgacagcgacaagaagtggggcttctgcccggaccaaggatacagtttgttcctcgtggcg gcgcatgagttcggccacgcgctgggcttagatcattcctcagtgccggaggcgctcatgtaccctatgtaccgctt cactgaggggccccccttgcataaggacgacgtgaatggcatccggcacctctatggtcctcgccctgaacct<u>gatt</u>

<u>acaaggatgacgacgataagt</u>gataa

NFAT response element  
(DNA)

(SEQ ID NO: 649)

ggaggaaaaactgtttcatacagaaggcgt (DNA)

(SEQ ID NO: 650)

ggaggaaaaactgtttcatacagaaggcgtggaggaaaaactgtttcatacagaaggcgtggaggaaaaactgtttc atacagaaggcgt CMV minimal promoter  
(DNA)

(SEQ ID NO: 651)

aggtaggcgtgtacggtgggaggtctatataagcagagctggtttagtgaaccgtcagatc

NFATREmCMV-MMP9  
(DNA)

(SEQ ID NO: 652)

ggaggaaaaactgtttcatacagaaggcgtggaggaaaaactgtttcatacagaaggcgtggaggaaaaactgtttc atacagaaggcgtagatctagactcaggtaggcgtgtacggtgggaggtctatataagcagagctggtttagtgaac cgtcagatc<u>tctaga</u>gccaccatgagcctctggcagcccctggtcctggtgctcctggtgctgggctgctgctttgc tgcccccagacagcgccagtccacccttgtgctctttcctggagacctgagaaccaatctcaccgacaggcagctgg cagaggaatacctgtaccgctatggttacactcgggtggcagagatgcgtggagagtcgaaatctctggggcctgcg ctgctgcttctccagaagcaactgtccctgcccgagaccggtgagctggatagcgccacgctgaaggccatgcgaac -continued cccacggtgcggggtcccagacctgggcagattccaaacctttgagggcgacctcaagtggcaccaccacaacatca cctattggatccaaaactactcggaagacttgccgcgggcggtgattgacgacgcctttgcccgcgccttcgcactg tggagcgcggtgacgccgctcaccttcactcgcgtgtacagccgggacgcagacatcgtcatccagtttggtgtcgc ggagcacggagacgggtatcccttcgacgggaaggacgggctcctggcacacgcctttcctcctggccccggcattc agggagacgcccatttcgacgatgacgagttgtggtccctgggcaagggcgtcgtggttccaactcggtttggaaac gcagatggcgcggcctgccacttccccttcatcttcgagggccgctcctactctgcctgcaccaccgacggtcgctc cgacggcttgccctggtgcagtaccacggccaactacgacaccgacgaccggtttggcttctgccccagcgagagac tctacacccaggacggcaatgctgatgggaaaccctgccagtttccattcatcttccaaggccaatcctactccgcc tgcaccacggacggtcgctccgacggctaccgctggtgcgccaccaccgccaactacgaccgggacaagctcttcgg cttctgcccgacccgagctgactcgacggtgatggggggcaactcggcgggggagctgtgcgtcttcccccttcactt tcctgggtaaggagtactcgacctgtaccagcgagggccgcggagatgggcgcctctggtgcgctaccacctcgaac tttgacagcgacaagaagtggggcttctgcccggaccaaggatacagtttgttcctcgtggcggcgcatgagttcgg ccacgcgctgggcttagatcattcctcagtgccggaggcgctcatgtacctatgtaccgcttcactgagggggcccc ccttgcataaggacgacgtgaatggcatccggcacctctatggtcctcgccctgaacctgagccacggcctccaacc accaccacaccgcagcccacggctcccccgacggtctgccccaccggacccccactgtccacccctcagagcgccc cacagctggccccacaggtcccccctcagctggccccacaggtcccccactgctggcccttctacggccactactg tgcctttgagtccggtggacgatgcctgcaacgtgaacatcttcgacgccatcgcggagattgggaaccagctgtat ttgttcaaggatgggaagtactggcgattctctgagggcaggggagccggccgcagggccccttccttatcgccga caagtggcccgcgctgcccgcaagctggactcggtctttgaggagcggctctccaagaagcttttcttcttctctg ggcgccaggtgtgggtgtacacaggcgcgtcggtgctgggcccgaggcgtctggacaagctgggcctgggagccgac gtggcccaggtgaccggggccctccggagtggcaggggggaagatgctgctgttcagcgggcggcgcctctggaggtt cgacgtgaaggcgcagatggtggatccccggagcgccagcgaggtggaccggatgttccccggggtgcctttggaca cgcacgacgtcttccagtaccgagagaaagcctatttctgccaggaccgcttctactggcgcgtgagttcccggagt gagttgaaccaggtggaccaagtgggctacgtgacctatgacatcctgcagtgccctgaggacg<u>gattacaaggatga</u>

<u>cgacgataag</u>tgataa

NFATREmCMV-MMP9cat
(DNA)

(SEQ ID NO: 653)
ggaggaaaaactgtttcatacagaaggcgtggaggaaaaactgtttcatacagaaggcgtggaggaaaaactgtttc atacagaaggcgtagatctagactcaggtaggcgtgtacggtgggaggtctatataagcagagctggtttagtgaac cgtcagatc<u>tctaga</u>gccaccatgttccaaacctttgagggcgacctcaagtggcaccaccacaacatcacctattg gatccaaaactactcggaagacttgccgcgggcggtgattgacgacgcctttgcccgcgccttcgcactgtggagcg cggtgacgccgctcaccttcactcgcgtgtacagccgggacgcagacatcgtcatccagtttggtgtcgcggagcac ggagacgggtatcccttcgacgggaaggacgggctcctggcacacgcctttcctcctggccccggcattcagggaga cgcccatttcgacgatgacgagttgtggtccctgggcaagggcgtcgtggttccaactcggtttggaaacgcagatg gcgcggcctgccacttcccctttcatcttcgagggccgctcctactctgcctgcaccaccgacggtcgctccgacggc ttgccctggtgcagtaccacggccaactacgacaccgacgaccggtttggcttctgccccagcgagagactctacac ccaggacggcaatgctgatgggaaaccctgccagtttccattcatcttccaaggccaatcctactccgcctgcacca cggacggtcgctccgacggctaccgctggtgcgccaccaccgccaactacgaccgggacaagctcttcggcttctgc ccgacccgagctgactcgacggtgatggggggcaactcggcgggggagctgtgcgtcttccccttcactttcctggg taaggagtactcgacctgtaccagcgagggccgcggagatgggcgcctctggtgcgctaccacctcgaactttgaca gcgacaagaagtggggcttctgcccggaccaaggatacagtttgttcctcgtggcggcgcatgagttcggccacgcg -continued ctgggcttagatcattcctcagtgccggaggcgctcatgtaccctatgtaccgcttcactgaggggccccccttgca taaggacgacgtgaatggcatccggcacctctatggtcctcgccctgaacctgattacaaggatgacgacgataagt gataa C2 scFir
(DNA)
                                                                       (SEQ ID NO: 654)
gaggtgcagctggtggagtctggggggaggcctggtcaagcctggggggtccctgagactctcctgtgcagcctctgg attcaccttcagtggctatgccatgagctgggtccgccaggctccagggaaggggctggagtgggtctcaaccatta gtagtggcggaacctacatatactaccccgactcagtgaagggccgattcaccatctccagagacaacgccaagaac tcactgtatctgcaaatgaacagcctgagagccgaggacacggccgtgtattactgtgcgagacttgggggggataa ttactacgaatacttcgatgtctggggcaaagggaccacggtcaccgtctcctccggcggtggcggatccggcggtg gcggatccggcggtggcggatccgacattgtgctgacccagtctccagcctccttggccgtgtctccaggacagagg gccaccatcacctgcagagccagtaagagtgtcagtaccagcggatactcctacatgcactggtatcagcagaaacc aggacaacctcctaaactcctgatttacctggcatccaatctggagagcggggtcccagccaggttcagcggcagtg ggtctgggaccgatttcaccctcacaattaatcctgtggaagctaatgatactgcaaattattactgtcagcacagt agggagctgcctttcacattcggcggagggaccaaggtggagatcaaacgaact (amino acids)
                                                                       (SEQ ID NO: 655)
EVQLVESGGGLVKPGGSLRLSCAASGFTFSGYAMSWVRQAPGKGLEWVSTISSGGTYIYYPDSVKGRFTISRDNAKN

SLYLQMNSLRAEDTAVYYCARLGGDNYYEYFDVWGKGTTVTVSSGGGGSGGGGSGGGGSDIVLTQSPASLAVSPGQR

ATITCRASKSVSTSGYSYMHWYQQKPGQPPKLLIYLASNLESGVPARFSGSGSGTDFTLTINPVEANDTANYYCQHS

RELPFTFGGGTKVEIKRT

CD8 transmembrane domain
(DNA)
                                                                       (SEQ ID NO: 656)
atctacatctgggcgcccttggccgggacttgtggggtccttctcctgtcactggttatcaccctttactgc (amino acids)
                                                                       (SEQ ID NO: 657)
IYIWAPLAGTCGVLLLSLVITLYC 4-1BB domain
(DNA)
                                                                       (SEQ ID NO: 658)
aaacggggcagaaagaaactcctgtatatattcaaacaaccatttatgagaccagtacaaactactcaagaggaaga tggctgtagctgccgatttccagaagaagaagaaggaggatgtgaactg (amino acids)
                                                                       (SEQ ID NO: 659)
KRGRKKLLYIFKQPFMRPVQTTQEEDGCSCRFPEEEEGGCEL CD3 zeta domain
(DNA)
                                                                       (SEQ ID NO: 660)
agagtgaagttcagcaggagcgcagacgcccccgcgtacaagcagggccagaaccagctctataacgagctcaatct aggacgaagagaggagtacgatgtttttggacaagagacgtggccgggaccctgagatggggggaaagccgagaagga agaaccctcaggaaggcctgtacaatgaactgcagaaagataagatggcggaggcctacagtgagattgggatgaaa ggcgagcgccggaggggcaaggggcacgatggcctttaccagggtctcagtacagccaccaaggacacctacgacgc ccttcacatgcaggccctgccccctcgc (amino acids)
                                                                       (SEQ ID NO: 661)
RVKFSRSADAPAYKQGQNQLYNELNLGRREEYDVLDKRRGRDPEMGGKPRRKNPQEGLYNELQKDKMAEAYSEIGMK

GERRRGKGHDGLYQGLSTATKDTYDALHMQALPPR

-continued

CAR-T C2 CD8/CD8/4-1BB/CD3z #44
N-CD81s-huMNC2scFv-CD8ecd fragment- CDB transmembrane- 4-1BB- CD3zeta-C
(DNA)

(SEQ ID NO: 718)

atggccttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagtg gctatgccatgagctgggtccgccaggctccagggaaggggctggagtgggtctcaaccattagtagtggcggaacc tacatatactaccccgactcagtgaagggccgattcaccatctccagagacaacgccaagaactcactgtatctgca aatgaacagcctgagagccgaggacacggccgtgtattactgtgcgagacttggggggggataattactacgaatact tcgatgtctgggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcggagggaccaaggtggagatcaaacgaactacaacaaccctgcccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcaccctttactgcaaacggggcagaaagaaactcctgtatatattcaaacaaccatttatgagaccagtacaaa ctactcaagaggaagatggctgtagctgccgatttccagaagaagaagaaggaggatgtgaactgagagtgaagttc agcaggagcgcagacgcccccgcgtacaagcagggccagaaccagctctataacgagctcaatctaggacgaagaga ggagtacgatgtttttggacaagagacgtggccgggaccctgagatgggggggaaagccgagaaggaagaaccctcagg aaggcctgtacaatgaactgcagaaagataagatggcggaggcctacagtgagattgggatgaaaggcgagcgccgg aggggcaaggggcacgatggcctttaccagggtctcagtacagccaccaaggacacctacgacgcccttcacatgca ggccctgccccctcgctgataa (amino acids)

(SEQ ID NO: 719)

MALPVTALLLPLALLLHAARPEVQLVESGGGLVKPGGSLRLSCAASGFTFSGYAMSWVRQAPGKGLEWVSTISSGGT

YIYYPDSVKGRFTISRDNAKNSLYLQMNSLRAEDTAVYYCARLGGDNYYEYFDVWGKGTTVTVSSGGGGSGGGGSGG

GGSDIVLTQSPASLAVSPGQRATITCRASKSVSTSGYSYMHWYQQKPGQPPKLLIYLASNLESGVPARFSGSGSGTD

FTLTINPVEANDTANYYCQHSRELPFTEGGGTKVEIKRTTTTPAPRPPTPAPTIASQPLSLRPEACRPAAGGAVHTR

GLDFACDIYIWAPLAGTCGVLLLSLVITLYCKRGRKKLLYIFKQPFMRPVQTTQEEDGCSCRFPEEEEGGCELRVKF

SRSADAPAYKQGQNQLYNELNLGRREEYDVLDKRRGRDPEMGGKPRRKNPQEGLYNELQKDKMAEAYSEIGMKGERR

RGKGHDGLYQGLSTATKDTYDALHMQALPPR**

NFATc1P2-MMP9
(DNA)

(SEQ ID NO: 774)

caggcctggggacactcgcggcgggaagatttggagggggagggggagggggagggggcgtgggggcgcggcctcgctgg agtcccccctgacccccccgaccccgcccaccggcctgggcgtcctcccgcggcccctcctccctcccggcgcccgg tgctctggggcgcgtgccacgcctggctcggcgccgtaggggcccccgcaggtagagacccctggaaatggcctcga cgccgcaggagcgaggcggccaccacccccgctaatccgggcacgtctctccaggccgaggcctgcggtggaaaagcc ggggttccatttgtgctgagtcggggcggccgaatggagccaggcctcgggacgcgggacggacgggctctggccgc gcaccttcgcgggctctgcagcgcccgaccgcctcccccggcagggaggaggcgcttgtggggggcacccacggggc acagtgatccctgggggtctgcgggacctcctgggccccgcagcagacacgagtttagcctttgggtttagtttaaat cacataaggggtgtcgtgcaatcgatttatggtttctacacaccagacactttaacctccaacccccccatccaaag ccaacaagaaaatgcggtgccgtgttggcagctgagctgcgcccgaagagacgcagggagacgtaagagaggaaagt -continued

```
gtgagtggccggggggcctccccccgtcagaagtcgcgcagtcgcgcccataaaacgcccccct ccgggcggct aggg caggtgagcgcgtccccgggcctccccacgccggccctgccacaggccgtct aggt cgagcagat atttacagaat aaaaatgacaataactcgacgtcccgggacggccacgcaatctgttagtaatttagcgggatgggaatttcctttct agggcctgccagt gaagcgcttttccaaatttccacagcgggggaagcctgcgatttt acat aatgacttcagcatg ccgggctttctcgacacccctccccggccccggccccgcccccgcccctttt ccagcagggccgggct ccctcc ggacacccgcgtggactcaggcgtcccgtctggcccgttcgcccccgtttccccc gccagccccagcgcccccctgc ccggcccccggattccccgttcccgcccct acgccccatccccctccccgtgcgccccctccccgtgcgccccctcc ccgtgcgcccccctccccgtgcgcccccctccccgtgcgcccccctccccgggcgcccccctccccgggcgcccc ccctccccgtgcgcccccct ccccgtgcgcccccct ccccgtgcgcgccccgcctcttgcgccctgcccccag gcgagcggctgccgcggcgcggggaggggcgggcgctcggcgactcgtcccgggcccgcgcgggcccgggcagc aggggcgtgatgtcacggcagggagggggcgcgggagccgccgggccggcgggaggcggggaggtgttttccagc tttaaaaaggcaggaggcagagcgcgggccctgcgtcagagcgagactcagaggctccgaactcgccggcggagtcgc cgcgccagatcccagcagcagggcgcggaagcttctctcgacattcgtttctagagccaccatgagcctctggcagc ccctggtcctggtgctcctggtgctgggctgctgctttgctgcccccagacagcgccagtccaccct tgtgctcttc cctggagacctgagaaccaatctcaccgacaggcagctggcagaggaat acctgtaccgctatggttacactcgggt ggcagagatgcgtggagagtcgaaatctctggggcctgcgctgctgcttctccagaagcaactgtccctgcccgaga ccggtgagctggat agcgccacgctgaaggccatgcgaaccccacggtgcggggtcccagacctgggcagattccaa acctttgagggcgacctcaagtggcaccaccacaacatcacctattggatccaaaact actcggaagacttgccgcg ggcggtgattgacgacgcctttgcccgcgccttcgcactgtggagcgcggtgacgccgctcaccttcactcgcgtgt acagccgggacgcagacatcgtcatccagtttggtgtcgcggagcacggagacgggtatcccttcgacgggaaggac gggctcctggcacacgcctttcctcctggccccggcattcagggagacgcccatttcgacgatgacgagttgtggtc cctgggcaagggcgtcgtggttccaactcggtttggaaacgcagatggcgcggcctgccacttcccct tcatcttcg agggccgctcctactctgcctgcaccaccgacggtcgctccgacggcttgccctggtgcagt accacggccaactac gacaccgacgaccggtttggcttctgccccagcgagagactctacacccaggacggcaatgctgatgggaaaccctg ccagtttccatt catcttccaaggccaatcctactccgcctgcaccacggacggtcgctccgacggct accgctggt gcgccaccaccgccaactacgaccgggacaagctcttcggcttctgcccgacccgagctgactcgacggtgatgggg ggcaactcggcggggggagctgtgcgtcttccccttcactttcctgggtaaggagtactcgacctgtaccagcgaggg ccgcggagatgggcgcctctggtgcgctaccacctcgaactttgacagcgacaagaagtggggcttctgcccggacc aaggat acagtttgttcctcgtggcggcgcatgagttcggccacgcgctgggcttagatcattcctcagtgccggag gcgctcatgtaccctatgtaccgcttcactgaggggcccccct tgcataaggacgacgtgaatggcatccggcacct ctatggtcctcgccctgaacctgagccacggcctccaaccaccaccacaccgcagcccacggctcccccgacggtct gccccaccggacccccactgtccacccctcagagcgccccacagctggccccacaggtccccctcagctggcccc acaggtcccccactgctggcccttctacggccactactgtgcctttgagtccggtggacgatgcctgcaacgtgaa catcttcgacgccatcgcggagattgggaaccagctgtatttgttcaaggatgggaagtactggcgattctctgagg gcaggggagcggccgcagggcccct tccttatcgccgacaagtggcccgcgctgccccgcaagctggactcggtc tttgaggagcggctctccaagaagctttt cttcttctctgggcgccaggtgtgggtgtacacaggcgcgtcggtgct gggcccgaggcgtctggacaagctgggcctgggagccgacgtggcccaggtgaccggggccctccggagtggcaggg ggaagatgctgctgttcagcgggcggcgcctctggaggttcgacgtgaaggcgcagatggtggatccccggagcgcc agcgaggtggaccggatgttccccgggggtgcctttggacacgcacgacgtcttccagtaccgagagaaagcctattt ctgccaggaccgcttctactggcgcgtgagttcccggagtgagttgaaccaggtggaccaagtgggct acgtgacct
```

-continued atgacatcctgcagtgccctgaggacgattacaaggatgacgacgataagtgataa

NFATc1P2-MMP9cat
(DNA)

(SEQ ID NO: 775)

caggcctggggacactcgcggcgggaagatttggagggggagggggaggggagggggcgtgggggcgcggcctcgctgg agtcccctgacccccgaccccgcccaccggcctgggcgtcctcccgcgggcccctcctcccctcccggcgcccgg tgctctggggcgcgtgccacgcctggctcggcgccgtaggggcccccgcaggtagagacccctggaaatggcctcga cgccgcaggagcgaggcggccaccaccccgctaatccgggcacgtctctccaggccgaggcctgcggtggaaaagcc ggggttccatttgtgctgagtcggggcggccgaatggagccaggcctcgggacgcgggacggacgggctctggccgc gcaccttcgcgggctctgcagcgcccgaccgcctcccccggcagggaggaggcgcttgtggggggcacccacggggc acagtgatccctgggggtctgcggacctcctgggcccccgcagcagacacgagtttagcctttgggtttagtttaaat cacataaggggtgtcgtgcaatcgatttatggtttctacacaccagacactttaacctccaacccccccatccaaag ccaacaagaaaatgcggtgccgtgttggcagctgagctgcgcccgaagagacgcagggagacgtaagagaggaaagt gtgagtggccggggggcctcccccgtcagaagtcgcgcagtcgcgcccataaaacgcccctccgggcggctaggg caggtgagcgcgtccccgggcctccccacgccggccctgccacaggccgtctaggtcgagcagatatttacagaat aaaaatgacaataactcgacgtcccgggacggccacgcaatctgttagtaatttagcgggatgggaatttcctttct agggcctgccagtgaagcgctttcccaaatttccacagcggggggaagcctgcgattttacataatgacttcagcatg ccgggctttctcgacacccctccccggcccccggcccccgcccccgccccttttccagcagggccgggctccctcc ggacacccgcgtggactcaggcgtcccgtctggcccgttcgccccgtttcccccgccagccccagcgcccccctgc ccggcccccggattccccgttcccgcccctacgccccatcccctccccgtgcgccctccccgtgcgcccccctcc ccgtgcgccccccctccccgtgcgcccccctccccgtgcgccccccctccccgggcgcccccctccccgggcgcccc ccctccccgtgcgccccccctccccgtgcgcccccctccccgtgcgcgccccgcctcttgcgcccctgcccccag gcgagcggctgccgcggcgcggggaggggcgggcgctcggcgactcgtcccggggcccgcgcgggcccgggcagc aggggcgtgatgtcacggcagggaggggcgcgggagccgccgggccggcggggaggcggggaggtgttttccagc tttaaaaaggcaggaggcagagcgcggccctgcgtcagagcgagactcagaggctccgaactcgccggcggagtcgc cgcgccagatcccagcagcagggcgcggaagcttctctcgacattcgtttctagagccaccatgagcctctggcagc ccctggtcctggtgctcctggtgctgggctgctgctttgctttccaaacctttgagggcgacctcaagtggcaccac cacaacatcacctattggatccaaaactactcggaagacttgccgcgggcggtgattgacgacgcctttgcccgcgc cttcgcactgtggagcgcggtgacgccgctcaccttcactcgcgtgtacagccgggacgcagacatcgtcatccagt ttggtgtcgcggagcacggagacgggtatcccttcgacgggaaggacgggctcctggcacacgcctttcctcctggc cccggcattcagggagacgcccatttcgacgatgacgagttgtggtccctgggcaagggcgtcgtggttccaactcg gtttggaaacgcagatggcgcggcctgccacttcccccttcatcttcgagggccgctcctactctgcctgcaccaccg acggtcgctccgacggcttgccctggtgcagtaccacggccaactacgacaccgacgaccggtttggcttctgcccc agcgagagactctacacccaggacggcaatgctgatgggaaaccctgccagtttccattcatcttccaaggccaatc ctactccgcctgcaccacggacggtcgctccgacggctaccgctggtgcgccaccaccgccaactacgaccgggaca agctcttcggcttctgcccgacccgagctgactcgacggtgatggggggcaactcggcgggggagctgtgcgtcttc cccttcactttcctgggtaaggagtactcgacctgtaccagcgagggccgcggagatgggcgcctctggtgcgctac cacctcgaactttgacagcgacaagaagtggggcttctgcccggaccaaggatacagtttgttcctcgtggcggcgc atgagttcggccacgcgctgggcttagatcattcctcagtgccggaggcgctcatgtaccctatgtaccgcttcact gagggggcccccccttgcataaggacgacgtgaatggcatccggcacctctatggtcctcgccctgaacctgattacaa ggatgacgacgataagtgataa -continued NFAT response element 2
(DNA)

(SEQ ID NO: 776)

aagaggaaaatttgtttcatacagaaggcgtt

NFAT response element 2 repeats
(DNA)

(SEQ ID NO: 777)

aagaggaaaatttgtttcatacagaaggcgttaagaggaaaatttgtttcatacagaaggcgttaagaggaaaattt gtttcatacagaaggcgttaagaggaaaatttgtttcatacagaaggcgtt CMV minimal promoter 2
(DNA)

(SEQ ID NO: 778)

taggcgtgtacggtgggaggcctatataagcagagctcgtttagtgaaccgtcagatcgcctggagacgccatccac gctgttttgacctccatagaagacaccgggaccgatccagc NFATRE2mCMV2-MMP9
(DNA)

(SEQ ID NO: 779)

aagaggaaaatttgtttcatacagaaggcgttaagaggaaaatttgtttcatacagaaggcgttaagaggaaaattt gtttcatacagaaggcgttaagaggaaaatttgtttcatacagaaggcgttactagttaggcgtgtacggtgggagg cctatataagcagagctcgtttagtgaaccgtcagatcgcctggagacgccatccacgctgttttgacctccataga agacaccgggaccgatccagcctctcgacattcgtttctagagccaccatgagcctctggcagcccctggtcctggt gctcctggtgctgggctgctgctttgctgcccccagacagcgccagtccacccttgtgctcttccctggagacctga gaaccaatctcaccgacaggcagctggcagaggaatacctgtaccgctatggttacactcgggtggcagagatgcgt ggagagtcgaaatctctggggcctgcgctgctgcttctccagaagcaactgtccctgcccgagaccggtgagctgga tagcgccacgctgaaggccatgcgaaccccacggtgcggggtcccagacctgggcagattccaaacctttgagggcg acctcaagtggcaccaccacaacatcacctattggatccaaaactactcggaagacttgccgcgggcggtgattgac gacgcctttgcccgcgccttcgcactgtggagcgcggtgacgccgctcaccttcactcgcgtgtacagccgggacgc agacatcgtcatccagtttggtgtcgcggagcacggagacgggtatcccttcgacgggaaggacgggctcctggcac acgcctttcctcctggccccggcattcagggagacgcccatttcgacgatgacgagttgtggtccctgggcaagggc gtcgtggttccaactcggtttggaaacgcagatggcgcggcctgccacttcccttcatcttcgagggccgctccta ctctgcctgcaccaccgacggtcgctccgacggcttgccctggtgcagtaccacggccaactacgacaccgacgacc ggtttggcttctgccccagcgagagactctacacccaggacggcaatgctgatgggaaaccctgccagtttccattc atcttccaaggccaatcctactccgcctgcaccacggacggtcgctccgacggctaccgctggtgcgccaccaccgc caactacgaccgggacaagctcttcggcttctgcccgacccgagctgactcgacggtgatggggggcaactcggcgg gggagctgtgcgtcttcccccttcactttcctgggtaaggagtactcgacctgtaccagcgagggccgcgcgagatggg cgcctctggtgcgctaccacctcgaactttgacagcgacaagaagtggggcttctgcccggaccaaggatacagttt gttcctcgtggcggcgcatgagttcggccacgcgctgggcttagatcattcctcagtgccggaggcgctcatgtacc ctatgtaccgcttcactgaggggcccccccttgcataaggacgacgtgaatggcatccggcacctctatggtcctcgc cctgaacctgagccacggcctccaaccaccaccacaccgcagcccacggctcccccgacggtctgccccaccggacc ccccactgtccacccctcagagcgccccacagctggccccacaggtccccctcagctggccccacaggtcccccca ctgctggcccttctacggccactactgtgcctttgagtccggtggacgatgcctgcaacgtgaacatcttcgacgcc atcgcggagattgggaaccagctgtatttgttcaaggatgggaagtactggcgattctctgagggcagggggagccg gccgcagggcccctttccttatcgccgacaagtggcccgcgctgcccgcaagctggactcggtctttgaggagcggc tctccaagaagcttttcttcttctctgggcgccaggtgtgggtgtacacaggcgcgtcggtgctgggcccgaggcgt ctggacaagctgggcctgggagccgacgtggcccaggtgaccggggcccctccggagtggcaggggggaagatgctgct gttcagcgggcggcgcctctggaggttcgacgtgaaggcgcagatggtggatccccggagcgccagcgaggtggacc -continued ggatgttccccgggggtgcctttggacacgcacgacgtcttccagtaccgagagaaagcctatttctgccaggaccgc ttctactggcgcgtgagttcccggagtgagttgaaccaggtggaccaagtgggctacgtgacctatgacatcctgca gtgccctgaggacgattacaaggatgacgacgataagtgataa NFATRE2mCMV2-MMP9cat
(DNA)

(SEQ ID NO: 780)

aagaggaaaatttgtttcatacagaaggcgttaagaggaaaatttgtttcatacagaaggcgttaagaggaaaattt gtttcatacagaaggcgttaagaggaaaatttgtttcatacagaaggcgttactagttaggcgtgtacggtgggagg cctatataagcagagctcgtttagtgaaccgtcagatcgcctggagacgccatccacgctgtttttgacctccataga agacaccgggaccgatccagcctcgagctctcgacattcgtttctagagccaccatgagcctctggcagcccctggt cctggtgctcctggtgctgggctgctgctttgctttccaaacctttgagggcgacctcaagtggcaccaccacaaca tcacctattggatccaaaactactcggaagacttgccgcgggcggtgattgacgacgcctttgcccgcgccttcgca ctgtggagcgcggtgacgccgctcaccttcactcgcgtgtacagccgggacgcagacatcgtcatccagtttggtgt cgcggagcacgagacgggtatcccttcgacgggaaggacgggctcctggcacacgcctttcctcctggccccggca ttcagggagacgcccatttcgacgatgacgagttgtggtccctgggcaagggcgtcgtggttccaactcggtttgga aacgcagatggcgcggcctgccacttcccctttcatcttcgagggccgctcctactctgcctgcaccaccgacggtcg ctccgacggcttgccctggtgcagtaccacggccaactacgacaccgacgaccggtttggcttctgccccagcgaga gactctacacccaggacgcaatgctgatgggaaaccctgccagtttccattcatcttccaaggccaatcctactcc gcctgcaccacggacggtcgctccgacggctaccgctggtgcgccaccaccgccaactacgaccgggacaagctctt cggcttctgcccgacccgagctgactcgacggtgatggggggcaactcggcgggggagctgtgcgtcttcccccttca ctttcctgggtaaggagtactcgacctgtaccagcgagggccgcggagatgggcgcctctggtgcgctaccacctcg aactttgacagcgacaagaagtggggcttctgcccggaccaaggatacagtttgttcctcgtggcggcgcatgagtt cggccacgcgctgggcttagatcattcctcagtgccggaggcgctcatgtaccctatgtaccgcttcactgagggc ccccccttgcataaggacgacgtgaatggcatccggcacctctatggtcctcgccctgaacctgattacaaggatgac gacgataagtgataa NFATc1 Promoter fragment (P1)
(DNA)

(SEQ ID NO: 781)

aggcaggaggaagaggaaaggggcgcagggcgctcggggagcagagccgggggcccgcggtggccgcagaggccggg ccggggcgcagaggccgggcgagctggccgcgctctgggccgccgcctccggaactccctgcgcctggcgcgcggcc accgtggtcccggcaacggcattaaacagagggaaacagacccgggattccgtcacccgggcgggggataaggacg gctttgagagcagacaggaaaagggagcttttctgcatggggtgaaaaaattatttattgaaggaggaggaggcggc agcggaggaaggggagggcgggaggaggaggaagagccggccgcccccgccccggccccggctcctcaggagccaa gggcagcctcgccaggtcggtcccgggctcgaggaccgcggctggggtcgaggggctcagtctcccacgtgaccggc tgggcgcgcccgccagacccggcctcgggattccctcctcccggcgagtctccgcccgccccgtcctggaggtggg gagaaggagggcggggcggggggacggaaactctccccgccaaatcctggcccaggcctggggacactcgcggcg ggaagatttggaggggagggggagggggagggcgtgggggcgcggcctcgctggagtcccccctgaccccccgacccc cgcccaccggcctgggcgtcctcccgcgggccctcctcccctcccggcgccggtgctctggggcgcgtgccacgcc tggctcggcgccgtaggggcccccgcaggtagagaccccctggaaatggcctcgacgccgcaggagcgaggcggccac cacccccgctaatccgggcacgtctctccaggccgaggcctgcggtggaaaagccggggttccatttgtgctgagtcg gggcggccgaatggagccaggcctcgggacgcgggacggacgggctctggccgcgcaccttcgcgggctctgcagcg cccgaccgcctccccggcagggaggaggcgcttgtggggggcacccacggggcacagtgatccctggggtctgcg gacctcctgggccccgcagcagacacgagtttagcctttgggtttagtttaaatcacataagggtgtcgtgcaatcg atttatggtttctacacaccagacactttaacctccaaccccccccatccaagccaacaagaaaatgcggtgccgtg -continued

```
ttggcagctgagctgcgcccgaagagacgcagggagacgtaagagaggaaagtgtgagtggccggggggcctccccc cgtcagaagtcgcgcagtcgcgcccataaaacgcccctccgggcggctagggcaggtgagcgcgtccccgggcctc cccacgccggcccctgccacagagccgtctaggtcgagcagatatttacagaataaaaatgacaataactcgacgtc ccgggacggccacgcaatctgttagtaatttagcgggatgggaatttcctttctagggcctgccagtgaagcgcttt tccaaatttccacagcggggggaagcctgcgattttacataatgacttcagcatgccgggctttctcgacacccctcc ccggcccccggcccccgcccccgcccctttccagcagggccgggctccctccggacacccgcgtggactcaggcg tcccgtctggcccgttcgcccccgtttcccccgccagcccagcgccccctgcccggccccggattccccgttcc cgcccctacgcccccatcccctccccgtgcgccccctccccgtgcgcccccctccccgtgcgcccccctccccgtgc gccccctccccgtgcgcccccctccccgggcgccccctccccgggcgcccccctccccgtgcgcccccctc cccgtgcgcccccctccccgtgcgcgccccgcctcttgcgccctgccccaggcgagcggctgccgcggcgcggg gaggggcgggcgctcggcgactcgtccccggggccccgcgcgggcccgggcagcaggggcgtgatgtcacggcaggg aggggcgcgggagccgccgggccggcggggaggcggggaggtgttttccagctttaaaaaggcaggaggcagagc
```

```
gcggccctgcgtcagagcgagactcagaggctccgaactcgccggcggagtcgccgcgccagatcccagcagcaggg
cgcgg
```

NFATc1 Promoter fragment (P2)
(DNA)

(SEQ ID NO: 782)

```
aggcaggaggaagaggaaaggggcgcagggcgctcggggagcagagccggggccccgcggtggccgcagaggccggg ccggggcgcagaggccgggcgagctggccgcgctctgggccgccgcctccggaactccctgcgcctggcgcgcggcc accgtggtcccggcaacggcattaaacagaggggaaacagacccgggattccgtcacccgggcggggggataaggacg gctttgagagcagacaggaaaaggggagctttttctgcatggggtgaaaaaattatttattgaaggaggaggaggcggc agcggaggaaggggagggggcgggaggaggaggaagagccggccgcccccgccccggcccggctcctcaggagccaa gggcagcctcgccaggtcggtcccgggctcgaggaccgcggctggggtcgagggctcagtctcccacgtgaccggc tgggcgcgccccgccagacccggcctcgggattccctcctcccggcgagtctccgcccgcccgtcctggaggtggg gagaaggagggcggggcgggggggacggaaactctccccgccaaatcctggccccaggcctggggacactcgcggcg ggaagatttggaggggagggggagggggaggggcgtggggcgcgcgcctcgctggagtcccctgacccccgacccc cgcccaccggcctgggcgtcctcccgcggcccctcctccctcccggcgccggtgctctggggcgcgtgccacgcc tggctcggcgccgtaggggcccccgcaggtagagacccctggaaatggcctcgacgccgcaggagcgaggcggccac caccccgctaatccgggcacgtctctccaggccgaggcctgcggtggaaaagccggggttccatttgtgctgagtcg gggcggccgaatggagccaggcctcgggacgcgggacggacgggctctggccgcgcaccttcgcgggctctgcagcg cccgaccgcctcccccggcagggaggaggcgcttgtggggggcacccacggggcacagtgatccctgggggtctgcg gacctcctgggccccgcagcagacacgagtttagcctttgggtttagtttaaatcacataagggtgtcgtgcaatcg atttatggtttctacacaccagacactttaacctccaacccccccatccaagcaacaagaaaatgcggtgccgtg ttggcagctgagctgcgcccgaagagacgcagggagacgtaagagaggaaagtgtgagtggccggggggcctccccc cgtcagaagtcgcgcagtcgcgcccataaaacgcccctccgggcggctagggcaggtgagcgcgtccccgggcctc cccacgccggcccctgccacagagccgtctaggtcgagcagatatttacagaataaaaatgacaataactcgacgtc ccgggacggccacgcaatctgttagtaatttagcgggatgggaatttcctttctagggcctgccagtgaagcgcttt tccaaatttccacagcggggggaagcctgcgattttacataatgacttcagcatgccgggctttctcgacacccctcc ccggcccccggcccccgcccccgcccctttccagcagggccgggctccctccggacacccgcgtggactcaggcg tcccgtctggcccgttcgcccccgtttcccccgccagcccagcgccccctgcccggccccggattccccgttcc cgcccctacgcccccatcccctccccgtgcgccccctccccgtgcgcccccctccccgtgcgcccccctccccgtgc gccccctccccgtgcgcccccctccccgggcgccccctccccgggcgcccccctccccgtgcgcccccctc
```

-continued cccgtgcgcccccctccccgtgcgcgccccgcctcttgcgcccctgcccccaggcgagcggctgccgcggcgcggg gaggggcgggcgctcggcgactcgtccccggggccccgcgcgggcccgggcagcaggggcgtgatgtcacggcaggg aggggcgcgggagccgccgggccggcggggaggcgggggaggtgttttccagctttaaaaaggcaggaggcagagc gcggccctgcgtcagagcgagactcagagg NFATc1 Promoter fragment (P3)
(DNA)

(SEQ ID NO: 783)

caggcctggggacactcgcggcgggaagatttggaggggaggggaggggagggcgtggggcgcggcctcgctgg agtcccctgacccccgaccccgcccaccggcctgggcgtcctcccgcgggcccctcctccccctcccggcgcccgg tgctctggggcgcgtgccacgcctggctcggcgccgtaggggcccccgcaggtagagaccccctggaaatggcctcga cgccgcaggagcgaggcggccaccaccccgctaatccgggcacgtctctccaggccgaggcctgcggtggaaaagcc ggggttccatttgtgctgagtcggggcggccgaatggagccaggcctcgggacgcgggacggacgggctctggccgc gcaccttcgcgggctctgcagcgcccgaccgcctcccccggcagggaggaggcgcttgtggggggcacccacggggc acagtgatccctggggggtctgcggacctcctgggcccccgcagcagacacgagtttagcctttgggtttagtttaaat cacataagggtgtcgtgcaatcgatttatggtttctacacaccagacactttaacctccaacccccccatccaaag ccaacaagaaaatgcggtgccgtgttggcagctgagctgcgcccgaagagacgcagggagacgtaagagaggaaagt gtgagtggccgggggggcctcccccccgtcagaagtcgcgcagtcgcgcccataaaacgcccctccgggcggctaggg caggtgagcgcgtcccgggcctccccacgccggccctgccacaggccgtctaggtcgagcagatatttacagaat aaaaatgacaataactcgacgtcccgggacggccacgcaatctgttagtaatttagcgggatgggaatttcctttct agggcctgccagtgaagcgcttttccaaatttccacagcgggggaagcctgcgattttacataatgacttcagcatg ccgggctttctcgacacccctccccggcccccggccccgcccccgcccctttccagcagggccgggctccctcc ggacacccgcgtggactcaggcgtcccgtctggcccgttcgcccccgtttccccgccagccccagcgccccctgc ccggcccccggattccccgttcccgcccctacgccccatccctccccgtgcgccctcccgtgcgccccctcc ccgtgcgcccccctccccgtgcgccccctccccgtgcgcccccctccccgggcgcccccctccccgggcgcccc ccctccccgtgcgcccccccctccccgtgcgcccccctccccgtgcgcgcccgcctcttgcgccctgcccccag gcgagcggctgccgcggcgcggggaggggcgggcgctcggcgactcgtccccggggcccgcgcgggcccgggcagc aggggcgtgatgtcacggcagggaggggcgcgggagccgccgggccggcggggaggcggggaggtgttttccagc tttaaaaaggcaggaggcagagcgcggccctgcgtcagagcgagactcagaggctccgaactcgccggcggagtcgc cgcgccagatcccagcagcagggcgcgg pNFAT-MMP9cat-1 gBLOCK sequence
(DNA)

(SEQ ID NO: 784)

aagaggaaaatttgtttcatacagaaggcgttactagttaggcgtgtacggtgggaggcctatataagcagagctcg tttagtgaaccgtcagatcgcctggagacgccatccacgctgttttgacctccatagaagacaccgggaccgatcca gcctctcgacattcgtttctagagccaccatgagcctctggcagcccctggtcctggtgctcctggtgctgggctgc tgctttgctttccaaacctttgagggcgacctcaagtggcaccaccacaacatcacctattggatccaaaactactc ggaagacttgccgcgggcggtgattgacgacgcctttgcccgcgccttcgcactgtggagcgcggtgacgccgctca ccttcactcgcgtgtacagccgggacgcagacatcgtcatccagtttggtgtcgcggagcacggagacgggtatccc ttcgacgggaaggacgggctcctggcacacgcctttcctcctggccccggcattcagggagacgcccatttcgacga tgacgagttgtggtccctgggcaagggcgtcgtggttccaactcggtttggaaacgcagatggcgcggcctgccact tcccttcatcttcgagggccgctcctactctgcctgcaccaccgacggtcgctccgacggcttgccctggtgcagt accacggccaactacgacaccgacgaccggtttggcttctgccccagcgagagactctacacccaggacggcaatgc tgatgggaaaccctgccagtttccattcatcttccaaggccaatcctactccgcctgcaccacggacggtcgctccg -continued acggctaccgctggtgcgccaccaccgccaactacgaccgggacaagctcttcggcttctgcccgacccgagctgac tcg NFAT consensus sequence:

(SEQ ID NO: 804)

(A/T)GGAAA(A/N)(A/T/C)N

Current NFAT RE (Form System Biosciences. The sequence is from the mouse IL2
promoter
(DNA)

(SEQ ID NO: 805)

aagaggaaaatttgtttcatacagaaggcgtt
Mouse IL2 Promoter (highlighted in green the NFAT RE used, highlighted in
yellow is the start codon)
(DNA)

(SEQ ID NO: 806)
aactagagacatataaaataacaccaacatccttagatacaacccttcctgagaatttattggacatcatactcttt ttaaaaagcataataaacatcaagacacttacacaaaatatgttaaattaaatttaaaacaacaacgacaaaatagt acctcaagctcaacaagcattttaggtgtccttagcttactatttctctggctaactgtatgaagccatctatcacc ctgtgtgcaattagctcattgtgtagataagaaggtaaaaccatcttgaaacaggaaaccaatatccttcctgtcta atcaacaaatctaaaagatttattctttcatctatctcctcttgcgtttgtccaccacaacaggctgcttacaggt tcaggatggttttgacaaagagaacattttcatgagttacttttgtgtctccacccaaagaggaaaatttgtttca tacagaaggcgttcattgtatgaattaaaactgccacctaagtgtgggctaacccgaccaagagggatttcacctaa atccattcagtcagtgtatggggtttaaagaaattccagagagtcatcagaagaggaaaaacaaaaggtaatgctt tctgccacacaggtagactctttgaaaatatgtgtaatatgtaaaacatcgtgacacccccatattattttccagc attaacagtataaattgcctcccatgctgaagagctgcctatcacccttgctaatcactcctcacagtgacctcaag tcctgcaggcatgtacagcatgcagctcgcatcctgtgtcac NFAT RE (Form PRomega. The sequence is from the humane IL2 promoter
(DNA)

(SEQ ID NO: 807)

ggaggaaaaactgtttcatacagaaggcgt

Possible NFAT RE from ET-1 promoter
(DNA)

(SEQ ID NO: 808)

tccagggaaaatcggagtagaacaagagggatg

Possible NFAT RE from ET-1 promoter
(DNA)

(SEQ ID NO: 809)

actgttggaaaacgtaaacacgttattaaacggt

Possible NFAT RE from human CD3y
(DNA)

(SEQ ID NO: 810)

tccttaacggaaaaacaaaa

Possible NFAT RE from human CD3y
(DNA)

(SEQ ID NO: 811)

aaaggaaaaagtatatgttc

Possible NFAT RE from human IL3 promoter
(DNA)

(SEQ ID NO: 812)

atgccatggaaagggtg

Possible NFAT RE from human GPC6
(DNA)

(SEQ ID NO: 813)

aaggggaaatgttgagtctaga

Possible NFAT RE from human growth hormone-releasing hormone (SEQ ID NO: 814)

(DNA)
AACTTGGAAAAGCATAG

-continued

NFATc1 promoter larger
(DNA)
(SEQ ID NO: 815)

ttatgccgtctagaggagacatactttctactcaaagctacacacatagactacaacgatgggaaaagacgacacac caacagcgacttcaggaaagctggagtggctgctaatgttagacaaaataggcttttttaaaaaaggttttattaaag aggaatgtttcgtaatgataaaagcactaatctgtgagaaagatacaacaatgataaacatacgtgcagctaataag agagctccaaaatctatgaagcaaaaactcacagaatgaggggagaagcagttctacaacagagaatggggacttcg atactccactttcaataatggatacaacaaccaggcagataacaaggcaacagaaggcctgaacaacagtataaacc aattagacctaccagatatctatagctagcacactccacccaacgacagcagaatacacattcttctcaagcgcaca agtaacatcctccaggatgggccatgttctaggccatcaaacaaactcaggtggtttgaggccagaggcctctcttt taaccaccacactagggccttcggaggaggcaagcagagagttgtcaaagaggccctcaggactgggtgcagtggct catgactgtaatcccagcactttagaaggctgaggcacaaggatcttttgagctcaggagttcaagaaatgagcact tatccactgggcgcggtggctcacgccagtaatcccagcactttgggaggcttaggcgggcggatcaagaggtcagaa gctcaagaccagcctgaccaacatggtgaaaccccgtctctactaaaagtacaaaaattagccgggcgtggtggcgc acacctgtaatcccagctacttgggaggctgaggcaggagaatcacttgaacccgggaggtggaggttgcagtgagt ggagatcacaccattgcaccccagcctgggcaacagagcgagactccgtctcaaaaaaaaaaaaaaaaaaaaaagaaa gaaagaaaagaaaaaaaagtgagcatgtattttgccagagtctggagattagaattaaattagcaaaccagaatt atagaaaaagctatttacttttaagtaaacagctgagatttttttttttaagtcagtgtgaatgaagctcacagcca tggttggagctgagaagaaggatttcccttttagttatgcacctgtgtcagcaccttctgactttccttctaaagtc tggggtgttcctgaggatccgtaagtttgggttcagggtttctacagcatgctgttacttgtgaaacatctcttta accatgtcccagagttgcccaggagtttaagaccagcctgagcaacatagcaagacctcatctcaacaacaacaaaa attagaaataaattagccaggtgtggtgacatgtgcctgtagtcccagctactcagaaggctgaggcatgaggatca cttgggcccaggaagttggggctgcagggagccctgttcatgccgctgcactccagcctgcaagacagagcagaaaa aaagaatcaggatcctgggcagagggaggagaggggaccggggtccagcaagcacttggggattgactgaatggcgt tggggagagatgactccaaagtcctggagtgggtgagaatgactgcgagtggcttttaggtggggaggttcctgcct ggccactccgggaggggacgtggggctgaagggtatcaggtgccgtgctgagcagtttggccttgatcctaatgccc tggacacacgtctagggtaggaaagttgactgatccattggtgatctgagttttttagacatggtggtagtccatgag gtgggtgttcatgctaagagtttagacagggaaacctatgaagcccttagcaaccctccagggaaggggcgtggtta aagagatgtttcataagtaacagcatggtatagaaactctgaaccccaaatgtatgggtcctcaggaacaccccaga ctttagaaggaaagtcagaaggtgctgacacgggtgtataactaaagggaaatccttctttctcagctccaaccatg gctgtgaggttcattcacactgacttaaaaaaaaaaatctcagtttacttaaaagtaaatagcttttttctataattc tggtttgctaatttaatcctagtctccagaccctggctaaataaatgcccatttctccagatggtctcaagagtctc tggacatcgtgggggcccttccctgttggttggaaggtgcctcaggaagaaggggggtggattctgagttgagtcaaa acctcaaagacccctgatgggaaaagctctcaagtgaccaccgctgtgggccagaatgcaaaactgcaggaacagaa cattcgcaggaacagaacacagtcgtattaagtgattttcccgagcaggaagtggcatctggcctgcggttcagtag ggggaggaaagggtgggcgcacctgccccctggctggcgcacctgccaggtagccccacgcgcaccgcgtgtgccga gcgcccctgaggatggaaagccccacgcggggcaggtggcacccaccctccgaagacgggacgggatggagcgttga gcttcggggcagctccggcccggcccgcgctggagacgcccgcatctgccaggatggcgtctcatagccctggtgct cacacatgacgccaggaagcccagcaacagtgaccgcccaggctctagaaaatattggacggggtggatgaacacc caagtgcgctccaggagaagggatttggcaccccaaggggcttttaaaacggtaagcttctaggggtgtctttgccc ccaataatccatagaaacaacagtcatctaaaaatagtcttgttttctgtcctaagctccttttaactttgttagtc atcaccaatcctaaaataaaacccgtgtaacgtctcccctagtagcggctataaacaaacctacgaggaggcaggag -continued gaagaggaaaggggcgcagggcgctcggggagcagagccgggggcccgcggtggccgcagaggccgggccggggcgc agaggccgggcgagctggccgcgctctgggccgccgcctccggaactccctgcgcctggcgcgcggccaccgtggtc ccggcaacggcattaaacagagggaaacagacccgggattccgtcacccgggcggggggataaggacggctttgaga gcagacaggaaaagggagcttttctgcatggggtgaaaaaattatttattgaaggaggaggaggcggcagcggagga aggggagggycgggaggaggaggaagagccggccgcccccgccccggccccggctcctcaggagccaagggcagcct cgccaggtcggtcccgggctcgaggaccgcgcgctggggtcgaggggctcagtctcccacgtgaccggctgggcgcgc cccgccagacccggcctcgggattccctcctcccggcgagtctccgcccgccccgtcctggaggtggggagaaggag ggcggggcggggggacggaaactctccccgccaaatcctggccccaggcctggggacactcgccggcgggaagattt ggaggggagggggaggggagggcgtggggcgcggcctcgctggagtcccccctgacccccgaccccgcccaccg gcctgggcgtcctcccgcggcccctcctccctcccggcgcccggtgctctggggcgcgtgccacgcctggctcggc gccgtaggggcccccgcaggtagagaccctggaaatggcctcgacgccgcaggagcgaggcggccaccaccccgct aatccgggcacgtctctccaggccgaggcctgcggtggaaaagccggggttccatttgtgctgagtcggggcggccg aatggagccaggcctcgggacgcgggacggacgggctctggccgcgcaccttcgcgggctctgcagcgcccgaccgc ctcccccggcagggaggaggcgcttgtggggggcacccacggggcacagtgatccctgggggtctgcggacctcctg ggccccgcagcagacacgagtttagcctttgggtttagtttaaatcacataagggtgtcgtgcaatcgatttatggt ttctacacaccagacactttaacctccaacccccccatccaaagccaacaagaaaatgcggtgccgtgttggcagc tgagctgcgcccgaagagacgcagggagacgtaagagaggaaagtgtgagtggccggggggcctcccccgtcagaa gtcgcgcagtcgcgcccataaaacgcccctccgggcggctagggcaggtgagcgcgtccccgggcctccccacgcc ggccctgccacaggccgtctaggtcgagcagatatttacagaataaaaatgacaataactcgacgtcccgggacgg ccacgcaatctgttagtaatttagcgggatgggaatttcctttctagggcctgccagtgaagcgcttttccaaattt ccacagcggggaagcctgcgattttacataatgacttcagcatgccgggctttctcgacacccctccccggccccc ggccccgcccccgcccctttttccagcagggccgggctccctccggacacccgcgtggactcaggcgtcccgtctg gcccgttcgcccccgtttccccgccagccccagcgcccccctgcccggccccggattccccgttcccgcccctac gcccccatccctcccgtgcgccctccccgtgcgcccccctccccgtgcgccccccctccccgtgcgcccccctc cccgtgcgccccccctccccgggcgccccctccccgggcgcccccctccccgtgcgccccccctccccgtgcgc ccccctccccgtgcgcgccccgcctcttgcgccctgccccaggcgagcggctgccgcggcgcggggaggggcgg gcgctcggcgactcgtccccggggcccgcgcgggcccgggcagcaggggcgtgatgtcacggcaggaggggggcgc gggagccgccgggccggcggggaggcggggaggtgttttccagctttaaaaaggcaggaggcagagcgcggccctg cgtcagagcgagactcagaggctccgaactcgccggcggagtcgccgcgccagatcccagcagcaggggcgcgggcac cggggcgcgggcagggctcggagccaccgcgcaggtcctagggccgcgggccgggccccgccacgcgcgcacacgccc ctcgatg NFATc3 promoter sequence
(DNA)
                                                                                          (SEQ ID NO: 816)
gcagccaggcagggtgggcgcgcgtaggggggcggggccgggcgcgcggcagggcgcgagagcgcaccgcggcggcg gtggcggcgactgtggggggggcggcggggaacattggctaagccgacagtggaggcttaggcaccggtggcgggcgg ctgcggttcctggtgctgctcggcgcgcggccagctttcggaacggaacgctcggcgtcgcgggcccgcccggaaa gtttgccgtggagtcgcgacctcttggcccgcgcggcccggcatgaagcggcgttgaggagctgctgccgccgcttg ccgctgccgccgccgccgcctgaggaggagctgcagcaccctgggccacgccg NFATc2 promoter sequence 1
(DNA)
                                                                                          (SEQ ID NO: 817)
cagagagaggctgcgttcagactggggcactgccatccctccgcatca
tggggtctgtggaccaaggtaactgactctcgatcccttccagccttttccgctcgctcctcccggcccttcctgc -continued tgctcccgtcccgggcagcactttcagctcccggcagaggtcggtgcgggaggcctggggacccccgctcgccctcgg cgcacaggtagcggggcccgcggaggggcgcccgcgcccccggccagggaagggacacttgggaaggcgactttggac aactttacgcgggggcagggaagtgtcccaggccgggattccctaggccagtctgtcgggaggattttcctctccac gggacaccgggagggattctcgctactaaccgctggctgtttaaccgtttcagcactcggcttttgacagcaa NFATc2 promoter sequence 2
(DNA)

(SEQ ID NO: 818)

catcatggggtctgtggaccaaggtaactgactctcgatcccttccagccttttccgctcgctc

NFATc1 response element consensus
(DNA)

(SEQ ID NO: 819)

cattttttccat

NFATc1 response element consensus
(DNA)

(SEQ ID NO: 820)

tttttcca

NFAT response elements contained within the Foxp3 enhancer region
(DNA)

(SEQ ID NO: 821)

acttgaaaatgagataaatgttcacctatgttggcttctagtctcttttatggcttcatt ttttccatttactatagaggttaagagtgtgggtactggagccagactgtctgggacaa

N+20

(SEQ ID NO: 822)

SNIKFRPGSVVVQLTLAFREGTINVHDVETQFNQYKTEAASRYNLTISDVSVSDVPFPFSAQSGA

N+20/C-27

(SEQ ID NO: 823)

SNIKFRPGSVVVQLTLAFREGTINVHDVETQFNQYKTE

N+9/C-9

(SEQ ID NO: 824)

VQLTLAFREGTINVHDVETQFNQYKTEAASRYNLTISDVSVSDVP

C-10

(SEQ ID NO: 825)

GTINVHDVETQFNQYKTEAASRYNLTISDVSVSDV

NME7-AB
(DNA)

(SEQ ID NO: 826)

atggaaaaaacgctggccctgattaaaccggatgcaatctccaaagctggcgaaattatcgaaattatcaacaaagc gggtttcaccatcacgaaactgaaaatgatgatgctgagccgtaaagaagccctggattttcatgtcgaccaccagt ctcgcccgttttttcaatgaactgattcaattcatcaccacgggtccgattatcgcaatggaaattctgcgtgatgac gctatctgcgaatggaaacgcctgctgggcccggcaaactcaggtgttgcgcgtaccgatgccagtgaatccattcg cgctctgtttggcaccgatggtatccgtaatgcagcacatggtccggactcattcgcatcggcagctcgtgaaatgg aactgttttttcccgagctctggcggttgcggtccggcaaacaccgccaaatttaccaattgtacgtgctgtattgtc aaaccgcacgcagtgtcagaaggcctgctgggtaaaattctgatggcaatccgtgatgctggctttgaaatctcggc catgcagatgttcaacatggaccgcgttaacgtcgaagaattctacgaagtttacaaaggcgtggttaccgaatatc acgatatggttacggaaatgtactccggtccgtgcgtcgcgatggaaattcagcaaaacaatgccaccaaaacgttt cgtgaattctgtggtccggcagatccggaaatcgcacgtcatctgcgtccgggtaccctgcgcgcaattttttggtaa aacgaaaatccagaacgctgtgcactgtaccgatctgccggaagacggtctgctggaagttcaatacttttttcaaaa ttctggataatctcgagcaccaccaccaccaccactga NME7-AB
(amino acids)

(SEQ ID NO: 827)

MEKTLALIKPDAISKAGEITEIINKAGFTITKLKMMMLSRKEALDFHVDHQSRPFFNELIQFITTGPIIAMEILRDD

AICEWKRLLGPANSGVARTDASESIRALFGTDGIRNAAHGPDSFASAAREMELFFPSSGGCGPANTAKFTNCTCCIV

KPHAVSEGLLGKILMAIRDAGFEISAMQMFNMDRVNVEEFYEVYKGVVTEYHDMVTEMYSGPCVAMEIQQNNATKTF

REFCGPADPEIARHLRPGTLRAIFGKTKIQNAVHCTDLPEDGLLEVQYFFKILDNLEHHHHHH

Human NME7 x1
(DNA)
                                      (SEQ ID NO: 828)
atgatgatgctttcaaggaaagaagcattggattttcatgtagatcaccagtcaagacccttttcaatgagctgat ccagtttattacaactggtcctattattgccatggagattttaagagatgatgctatatgtgaatggaaaagactgc tgggacctgcaaactctggagtggcacgcacagatgcttctgaaagcattagagccctctttggaacagatggcata agaaatgcagcgcatggccctgattcttttgcttctgcggccagagaaatggagttgtttttcttcaagtggagg ttgtgggccggcaaacactgctaaatttactaattgtacctgttgcattgttaaaccccatgctgtcagtgaaggac tgttgggaaagatcctgatggctatccgagatgcaggttttgaaatctcagctatgcagatgttcaatatggatcgg gttaatgttgaggaattctatgaagtttataaaggagtagtgaccgaatatcatgacatggtgacagaaatgtattc tggcccttgtgtagcaatggagattcaacagaataatgctacaaagacatttcgagaattttgtggacctgctgatc ctgaaattgcccggcatttacgccctggaactctcagagcaatctttggtaaaactaagatccagaatgctgttcac tgtactgatctgccagaggatggcctattagaggttcaatacttcttcaagatcttggataatctcgagcaccacca ccaccaccactga (amino acids)
                                        (SEQ ID NO: 829)
MMMLSRKEALDFHVDHQSRPFFNELIQFITTGPIIAMEILRDDAICEWKRLLGPANSGVARTDASESIRALFGTDGI

RNAAHGPDSFASAAREMELFFPSSGGCGPANTAKFTNCTCCIVKPHAVSEGLLGKILMAIRDAGFEISAMQMFNMDR

VNVEEFYEVYKGVVTEYHDMVTEMYSGPCVAMEIQQNNATKTFREFCGPADPEIARHLRPGTLRAIFGKTKIQNAVH

CTDLPEDGLLEVQYFFKILDNLEHHHHHH*

Mouse Antibody 17H6 Heavy chain: DNA sequence
Signal sequence-FR1-CDR1-FR2-CDR2-FR3-CDR3-FR4
                                        (SEQ ID NO: 830)
ATGAAGTTGTGGCTGAACTGGATTTTCCTTGTAACACTTTTAAATGGTATCCAGTGTGAGGTGAAGCTGGTGGAGTC

TGGAGGAGGCTTGGTACAGCCTGGGGGTTCTCTGAGACTCTCCTGTGCAACTTCTGGGTTCACCTTCACTGATTACT

ACATGAGCTGGGTCCGCCAGCCTCCAAGAAAGGCACTTGAGTGGTTGGGTTTTATTAGAAACAAAGCTAATGGTTAC

ACAGCAGAGTACAGTGCGTCTGTGAAGGGTCGGTTCACCATCTCCAGAGATGTTTCCCAAAACCTCCTCTATCTTCA

AATGAACATCCTGAGAGCTGAGGACAGTGCCACTTATTACTGTGCAAAAGATTACTACGGTAGTAACCCTGCCTGGT

TTGCTTACTGGGGCCAAGGGACTCTGGTCACTGTCTCTGCA

Mouse Antibody 17H6 Heavy chain: Amino acid sequence
Signal peptide-FR1-CDR1-FR2-CDR2-FR3-CDR3-FR4
                                        (SEQ ID NO: 831)
MKLWLNWIFLVTLLNGIQCEVKLVESGGGLVQPGGSLRLSCATSGFTFTDYYMSWVRQPPRKALEWLGFIRNKANGY

TAEYSASVKGRFTISRDVSQNLLYLQMNILRAEDSATYYCAKDYYGSNPAWFAYWGQGTLVTVSA

Mouse 17H6 heavy chain variable framework 1 (FW1) sequence:
(DNA)
                                        (SEQ ID NO: 832)
GAGGTGAAGCTGGTGGAGTCTGGAGGAGGCTTGGTACAGCCTGGGGGTTCTCTGAGACTCTCCTGTGCAACTTCTGG

GTTCACCTTCACT (amino acids)
                                        (SEQ ID NO: 833)
EVKLVESGGGLVQPGGSLRLSCATSGFTFT Mouse 17H6 heavy chain variable complementarity determining regions 1 (CDR1)
sequence:
(DNA)
                                        (SEQ ID NO: 834)
GATTACTACATGAGC (amino acids)
                                        (SEQ ID NO: 835)
DYYMS -continued Mouse 17H6 heavy chain variable framework 2 (FW2) sequence:
(DNA)
(SEQ ID NO: 836)
GAGGTGAAGCTGGTGGAGTCTGGAGGAGGCTTGGTACAGCCTGGGGGTTCTCTGAGACTCTCCTGTGCAACTTCTGG

GTTCACCTTCACT (amino acids)
(SEQ ID NO: 837)
WVRQPPRKALEWLG

Mouse 17H6 heavy chain variable complementarity determining regions 2 (CDR2)
sequence:
(DNA)
(SEQ ID NO: 838)
TTTATTAGAAACAAAGCTAATGGTTACACAGCAGAGTACAGTGCGTCTGTGAAGGGT (amino acids)
(SEQ ID NO: 839)
FIRNKANGYTAEYSASVKG Mouse 17H6 heavy chain variable framework 3 (FW3) sequence:
(DNA)
(SEQ ID NO: 840)
CGGTTCACCATCTCCAGAGATGTTTCCCAAAACCTCCTCTATCTTCAAATGAACATCCTGAGAGCTGAGGACAGTGC

CACTTATTACTGTGCAAAA (amino acids)
(SEQ ID NO: 841)
RFTISRDVSQNLLYLQMNILRAEDSATYYCAK Mouse 17H6 heavy chain variable complementarity determining regions 3 (CDR3)
sequence:
(DNA)
(SEQ ID NO: 842)
GATTACTACGGTAGTAACCCTGCCTGGTTTGCTTAC (amino acids)
(SEQ ID NO: 1785)
DYYGSNPAWFAY Mouse 17H6 heavy chain variable framework 4 (FW4) sequence:
(DNA)
(SEQ ID NO: 843)
TGGGGCCAAGGGACTCTGGTCACTGTCTCTGCA (amino acids)
(SEQ ID NO: 939)
WGQGTLVTVSA Mouse Antibody 17H6 Light chain: DNA sequence
Signal sequence-FR1-CDR1-FR2-CDR2-FR3-CDR3-FR4
(SEQ ID NO: 844)
ATGAAGTTGCCTGTGAGGCTGTTGGTGCTGATGTTCTGGATTCCTGCTTCCAACAGTGATATTTTGATGACCCAGAC

TCCACTCTCCCTGCCTGTCAGTCTTGGAGATCAAGCCTCCATCTCTTGCAGATCTAGTCAGAGCATTGTACATAGTA

GTGGAAACACCTTTTTAGAATGGTACCTGCAGAAACCTGGCCAGTCTCCAAAGCTCCTGATCTACAAAGTTTCCAAC

CGATTTTCTGGGGTCCCAGACAGGTTCAGTGGCAGTGGATCAGGGATAGATTTCACACTCAAGATCAGCAGAGTGGA

GGCTGAGGATCTGGGAGTTTATTACTGCTTTCAAGGTTCACATGTTCCTTTCACGTTCGGCTCGGGGACAAAGTTGG

AAATAAAA

Mouse Antibody 17H6 Light chain: Amino acid sequence
Signal peptide-FR1-CDR1-FR2-CDR2-FR3-CDR3-FR4
(SEQ ID NO: 845)
MKLPVRLLVLMFWIPASNSDILMTQTPLSLPVSLGDQASISCRSSQSIVHSSGNTFLEWYLQKPGQSPKLLIYKVSN

RFSGVPDRFSGSGSGIDFTLKISRVEAEDLGVYYCFQGSHVPFTFGSGTKLEIK

Mouse 17H6 light chain variable framework 1 (FW1) sequence:
(DNA)
(SEQ ID NO: 846)
GATATTTTGATGACCCAGACTCCACTCTCCCTGCCTGTCAGTCTTGGAGATCAAGCCTCCATCTCTTGC -continued

```
(amino acids)
                                              (SEQ ID NO: 847)
DILMTQTPLSLPVSLGDQASISC Mouse 17H6 light chain variable complementarity determining regions 1 (CDR1)
sequence:
(DNA)
                                              (SEQ ID NO: 848)
AGATCTAGTCAGAGCATTGTACATAGTAGTGGAAACACCTTTTTAGAA (amino acids)
                                              (SEQ ID NO: 849)
RSSQSIVHSSGNTFLE Mouse 17H6 light chain variable framework 2 (FW2) sequence:
(DNA)
                                              (SEQ ID NO: 850)
TGGTACCTGCAGAAACCTGGCCAGTCTCCAAAGCTCCTGATCTAC (amino acids)
                                              (SEQ ID NO: 851)
WYLQKPGQSPKLLIY Mouse 17H6 light chain variable complementarity determining regions 2 (CDR2)
sequence:
(DNA)
                                              (SEQ ID NO: 852)
AAAGTTTCCAACCGATTTTCT (amino acids)
                                              (SEQ ID NO: 853)
KVSNRFS Mouse 17H6 light chain variable framework 3 (FW3) sequence:
(DNA)
                                              (SEQ ID NO: 854)
GGGGTCCCAGACAGGTTCAGTGGCAGTGGATCAGGGATAGATTTCACACTCAAGATCAGCAGAGTGGAGGCTGAGGA

TCTGGGAGTTTATTACTGC (amino acids)
                                              (SEQ ID NO: 855)
GVPDRFSGSGSGIDFTLKISRVEAEDLGVYYC Mouse 17H6 light chain variable complementarity determining regions 3 (CDR3)
sequence:
(DNA)
                                              (SEQ ID NO: 856)
TTTCAAGGTTCACATGTTCCTTTCACG (amino acids)
                                              (SEQ ID NO: 857)
FQGSHVPFT Mouse 17H6 light chain variable framework 4 (FW4) sequence:
(DNA)
                                              (SEQ ID NO: 858)
TTCGGCTCGGGGACAAAGTTGGAAATAAAA (amino acids)
                                              (SEQ ID NO: 859)
FGSGTKLEIK Mouse antibody 39H5 Heavy chain: DNA sequence
Signal sequence-FR1-CDR1-FR2-CDR2-FR3-CDR3-FR4
                                              (SEQ ID NO: 860)
ATGGCTTGGGTGTGGACCTTGCTATTCCTGATGGCAGCTGCCCAAAGTGCCCAAGCACAGATCCAGTTGGTGCAGTC

TGGACCTGAGCTGAAGAAGCCTGGAGAGACAGTCAAGATCTCCTGCAAGGCTTCTGGGTATACCTTCACAAACTATG

GAATGAACTGGGTGAAGCAGGCTCCAGGAAAGGGTTTAAAGTGGATGGGCTGGATAAACACCTACACTGGAGAGCCA

ACATATGTTGGTGACTTCAAGGGACGGTTTGCCTTCTCTTTGGAGACCTCTGCCAGCACTGCCTATTTGCAGATCAA

CAACCTCAAAAATGAGGACACGGCTACATATTTTTGTGTTAGAGGTATCCACGGCTACGTGGACTACTGGGGCCAAG

GCACCACTCTCACAGTCTCCTCA
```

-continued

Mouse antibody 39H5 Heavy chain: Amino acid sequence
Signal peptide-FR1-CDR1-FR2-CDR2-FR3-CDR3-FR4
                                                              (SEQ ID NO: 861)
MAWVWTLLFLMAAAQSAQAQIQLVQSGPELKKPGETVKISCKASGYTFTNYGMNWVKQAPGKGLKWMGWINTYTGEP

TYVGDFKGRFAFSLETSASTAYLQINNLKNEDTATYFCVRGIHGYVDYWGQGTTLTVSS

Mouse antibody 39H5 heavy chain variable framework 1 (FW1) sequence:
(DNA)
                                                              (SEQ ID NO: 862)
CAGATCCAGTTGGTGCAGTCTGGACCTGAGCTGAAGAAGCCTGGAGAGACAGTCAAGATCTCCTGCAAGGCTTCTGG

GTATACCTTCACA (amino acids)
                                                              (SEQ ID NO: 863)
QIQLVQSGPELKKPGETVKISCKASGYTFT Mouse antibody 39H5 heavy chain variable complementarity determining regions
1 (CDR1) sequence:
(DNA)
                                                              (SEQ ID NO: 864)
AACTATGGAATGAAC (amino acids)
                                                              (SEQ ID NO: 865)
NYGMN Mouse antibody 39H5 heavy chain variable framework 2 (FW2) sequence:
(DNA)
                                                              (SEQ ID NO: 866)
TGGGTGAAGCAGGCTCCAGGAAAGGGTTTAAAGTGGATGGGC (amino acids)
                                                              (SEQ ID NO: 867)
WVKQAPGKGLKWMG Mouse antibody 39H5 heavy chain variable complementarity determining regions
2 (CDR2) sequence:
(DNA)
                                                              (SEQ ID NO: 868)
TGGATAAACACCTACACTGGAGAGCCAACATATGTTGGTGACTTCAAGGGA (amino acids)
                                                              (SEQ ID NO: 869)
WINTYTGEPTYVGDFKG Mouse antibody 39H5 heavy chain variable framework 3 (FW3) sequence:
(DNA)
                                                              (SEQ ID NO: 870)
CGGTTTGCCTTCTCTTTGGAGACCTCTGCCAGCACTGCCTATTTGCAGATCAACAACCTCAAAAATGAGGACACGGC

TACATATTTTTGTGTTAGA (amino acids)
                                                              (SEQ ID NO: 871)
RFAFSLETSASTAYLQINNLKNEDTATYFCVR Mouse antibody 39H5 heavy chain variable complementarity determining regions
3 (CDR3) sequence:
(DNA)
                                                              (SEQ ID NO: 872)
GGTATCCACGGCTACGTGGACTAC (amino acids)
                                                              (SEQ ID NO: 873)
GIHGYVDY Mouse antibody 39H5 heavy chain variable framework 4 (FW4) sequence:
(DNA)
                                                              (SEQ ID NO: 874)
TGGGGCCAAGGCACCACTCTCACAGTCTCCTCA (amino acids)
                                                              (SEQ ID NO: 875)
WGQGTTLTVSS Mouse antibody 39H5 Light chain: DNA sequence
Signal sequence-FR1-CDR1-FR2-CDR2-FR3-CDR3-FR4

(SEQ ID NO: 876)
ATGAAGTTGCCTGTTAGGCTGTTGGTGCTGATGTTCTGGATTCCTGCTTCCAGCAGTGATGTTTTGATGACCCAAAC

TCCACTCTCCCTGCCTGTCAGTCTTGGAGATCAAGCCTCCATCTCTTGCAGATCTAGTCAGAGCATTGTACATAGAA

ATGGAAACACCTATTTAGAATGGTACCTGCAGAAACCAGGCCAGTCTCCAAAGCTCCTGATCTACAAAGTTTCCAAC

CGATTTTCTGGGGTCCCAGACAGGTTCAGTGGCAGTGGATCAGGGACAGATTTCACACTCAAGATCAGCAGAGTGGA

GGCTGAGGATCTGGGAGTTTATTACTGCTTTCAAGGTTCACATCTTCCGTGGACGTTCGGTGGAGGCACCAAGCTGG

AAATCAAA

Mouse antibody 39H5 Light chain: Amino acid sequence
Signal peptide-FR1-CDR1-FR2-CDR2-FR3-CDR3-FR4

(SEQ ID NO: 877)
MKLPVRLLVLMFWIPASSSDVLMTQTPLSLPVSLGDQASISCRSSQSIVHRNGNTYLEWYLQKPGQSPKLLIYKVSN

RFSGVPDRFSGSGSGTDFTLKISRVEAEDLGVYYCFQGSHLPWTEGGGTKLEIK

Mouse antibody 39H5 light chain variable framework 1 (FW1) sequence:
(DNA)

(SEQ ID NO: 878)
GATGTTTTGATGACCCAAACTCCACTCTCCCTGCCTGTCAGTCTTGGAGATCAAGCCTCCATCTCTTGC (amino acids)

(SEQ ID NO: 879)
DVLMTQTPLSLPVSLGDQASISC

Mouse antibody 39H5 light chain variable complementarity determining regions
1 (CDR1) sequence:
(DNA)

(SEQ ID NO: 880)
AGATCTAGTCAGAGCATTGTACATAGAAATGGAAACACCTATTTAGAA (amino acids)

(SEQ ID NO: 881)
RSSQSIVHRNGNTYLE

Mouse antibody 39H5 light chain variable framework 2 (FW2) sequence:
(DNA)

(SEQ ID NO: 882)
TGGTACCTGCAGAAACCAGGCCAGTCTCCAAAGCTCCTGATCTAC (amino acids)

(SEQ ID NO: 883)
WYLQKPGQSPKLLIY

Mouse antibody 39H5 light chain variable complementarity determining regions
2 (CDR2) sequence:
(DNA)

(SEQ ID NO: 884)
AAAGTTTCCAACCGATTTTCT (amino acids)

(SEQ ID NO: 885)
KVSNRFS

Mouse antibody 39H5 light chain variable framework 3 (FW3) sequence:
(DNA)

(SEQ ID NO: 886)
GGGGTCCCAGACAGGTTCAGTGGCAGTGGATCAGGGACAGATTTCACACTCAAGATCAGCAGAGTGGAGGCTGAGGA

TCTGGGAGTTTATTACTGC (amino acids)

(SEQ ID NO: 887)
GVPDRFSGSGSGTDFTLKISRVEAEDLGVYYC

Mouse antibody 39H5 light chain variable complementarity determining regions
3 (CDR3) sequence:
(DNA)

(SEQ ID NO: 888)
TTTCAAGGTTCACATCTTCCGTGGACG (amino acids)

(SEQ ID NO: 889)
FQGSHLPWT

-continued

Mouse antibody 39H5 light chain variable framework 4 (FW4) sequence:
(DNA)
                                                              (SEQ ID NO: 890)
TTCGGTGGAGGCACCAAGCTGGAAATCAAA (amino acids)
                                                              (SEQ ID NO: 891)
FGGGTKLEIK Antibody 3C5 Heavy chain: DNA sequence
Signal sequence-FR1-CDR1-FR2-CDR2-FR3-CDR3-FR4
                                                              (SEQ ID NO: 892)
ATGGCTTGGGTGTGGACCTTGCTGTTCCTGATGGCAGCTGCCCAAAGTGCCCAAGCACAGATCCAGTTGGTGCAGTC

TGGACCTGAGCTGAAGAAGCCTGGAGAGACAGTCAAGATCTCCTGCAAGGCTTCTGGGTATACCTTCACAAACTATG

GAATGAACTGGGTGAAGCAGGCTCCAGGAAAGGGTTTAAAGTGGATGGGCTGGATAAACACCTACACTGGAAAGCCA

ACATATGCTGATGACTTCAAGGGACGGTTTGCCTTCTCTTTGGAGACCTCTGCCAGCACTGCCTATTTGCAGATCAA

CAACCTCAAAAATGAGGACACGGCTACATATTTCTGTGCAAGAGGGGGACTAGATGGTTACTACGGCTACTGGGGCC

AAGGCACCACTCTCACAGTCTCCTCA

Antibody 3C5 Heavy chain: Amino acid sequence
Signal peptide-FR1-CDR1-FR2-CDR2-FR3-CDR3-FR4
                                                              (SEQ ID NO: 893)
MAWVWTLLFLMAAAQSAQAQIQLVQSGPELKKPGETVKISCKASGYTFTNYGMNWVKQAPGKGLKWMGWINTYTGKP

TYADDFKGRFAFSLETSASTAYLQINNLKNEDTATYFCARGGLDGYYGYWGQGTTLTVSS

Mouse antibody 3C5 heavy chain variable framework 1 (FW1) sequence:
(DNA)
                                                              (SEQ ID NO: 894)
CAGATCCAGTTGGTGCAGTCTGGACCTGAGCTGAAGAAGCCTGGAGAGACAGTCAAGATCTCCTGCAAGGCTTCTGG

GTATACCTTCACA (amino acids)
                                                              (SEQ ID NO: 895)
QIQLVQSGPELKKPGETVKISCKASGYTFT Mouse antibody 3C5 heavy chain variable complementarity determining regions 1
(CDR1) sequence:
(DNA)
                                                              (SEQ ID NO: 896)
AACTATGGAATGAAC (amino acids)
                                                              (SEQ ID NO: 897)
NYGMN Mouse antibody 3C5 heavy chain variable framework 2 (FW2) sequence:
(DNA)
                                                              (SEQ ID NO: 898)
TGGGTGAAGCAGGCTCCAGGAAAGGGTTTAAAGTGGATGGGC (amino acids)
                                                              (SEQ ID NO: 899)
WVKQAPGKGLKWMG Mouse antibody 3C5 heavy chain variable complementarity determining regions 2
(CDR2) sequence:
(DNA)
                                                              (SEQ ID NO: 900)
TGGATAAACACCTACACTGGAAAGCCAACATATGCTGATGACTTCAAGGGA (amino acids)
                                                              (SEQ ID NO: 901)
WINTYTGKPTYADDFKG Mouse antibody 3C5 heavy chain variable framework 3 (FW3) sequence:
(DNA)
                                                              (SEQ ID NO: 902)
CGGTTTGCCTTCTCTTTGGAGACCTCTGCCAGCACTGCCTATTTGCAGATCAACAACCTCAAAAATGAGGACACGGC

TACATATTTCTGTGCAAGA

-continued (amino acids)
                                                              (SEQ ID NO: 903)
RFAFSLETSASTAYLQINNLKNEDTATYFCAR Mouse antibody 3C5 heavy chain variable complementarity determining regions 3
(CDR3) sequence:
(DNA)
                                                              (SEQ ID NO: 904)
GGGGGACTAGATGGTTACTACGGCTAC (amino acids)
                                                              (SEQ ID NO: 905)
GGLDGYYGY Mouse antibody 3C5 heavy chain variable framework 4 (FW4) sequence:
(DNA)
                                                              (SEQ ID NO: 906)
TGGGGCCAAGGCACCACTCTCACAGTCTCCTCA (amino acids)
                                                              (SEQ ID NO: 907)
WGQGTTLTVSS Antibody 3C5 Light chain: DNA sequence (393 bp)
Signal sequence-FR1-CDR1-FR2-CDR2-FR3-CDR3-FR4
                                                              (SEQ ID NO: 908)
ATGAGTCCTGCCCAGTTCCTGTTTCTGCTAGTGCTCTCGATTCAGGAAACCAACGGTGATGTTGTGATGGCTCAGAC

CCCACTCACTTTGTCGGTTACCATTGGACAACCAGCCTCCATCTCTTGCAAATCAAGTCAGAGCCTCTTACATAGTA

AAGGAAAGACATATTTGAATTGGTTATTACAGAGGCCAGGCCAGTCTCCAAAGCTCCTAATCTATCTGGTGTCTAAA

CTGGAATCTGGAGTCCCTGACAGGTTCAGTGGCAGTGGATCAGGGACAGATTTCACACTGAAAATCAGCAGAGTGGA

GGCTGAAGATTTGGGAGTTTATTACTGCTTGCAAACTACACATTTTCCGTGGACGTTCGGTGGAGGCACCAAGCTGG

AAATCAAA

Antibody 3C5 Light chain: Amino acid sequence (131 aa)
Signal peptide-FR1-CDR1-FR2-CDR2-FR3-CDR3-FR4
                                                              (SEQ ID NO: 909)
MSPAQFLFLLVLSIQETNGDVVMAQTPLTLSVTIGQPASISCKSSQSLLHSKGKTYLNWLLQRPGQSPKLLIYLVSK

LESGVPDRFSGSGSGTDFTLKISRVEAEDLGVYYCLQTTHFPWTFGGGTKLEIK

Mouse antibody 3C5 light chain variable framework 1 (FW1) sequence:
(DNA)
                                                              (SEQ ID NO: 910)
GATGTTGTGATGGCTCAGACCCCACTCACTTTGTCGGTTACCATTGGACAACCAGCCTCCATCTCTTGC (amino acids)
                                                              (SEQ ID NO: 911)
DVVMAQTPLTLSVTIGQPASISC Mouse antibody 39H5 light chain variable complementarity determining regions
1 (CDR1) sequence:
(DNA)
                                                              (SEQ ID NO: 912)
AAATCAAGTCAGAGCCTCTTACATAGTAAAGGAAAGACATATTTGAAT (amino acids)
                                                              (SEQ ID NO: 913)
KSSQSLLHSKGKTYLN Mouse antibody 3C5 light chain variable framework 2 (FW2) sequence:
(DNA)
                                                              (SEQ ID NO: 914)
TGGTTATTACAGAGGCCAGGCCAGTCTCCAAAGCTCCTAATCTAT (amino acids)
                                                              (SEQ ID NO: 915)
WLLQRPGQSPKLLIY Mouse antibody 3C5 light chain variable complementarity determining regions 2
(CDR2) sequence:
(DNA)
                                                              (SEQ ID NO: 916)
CTGGTGTCTAAACTGGAATCT -continued (amino acids)
                                                          (SEQ ID NO: 917)
LVSKLES Mouse antibody 3C5 light chain variable framework 3 (FW3) sequence:
(DNA)
                                                          (SEQ ID NO: 918)
GGAGTCCCTGACAGGTTCAGTGGCAGTGGATCAGGGACAGATTTCACACTGAAAATCAGCAGAGTGGAGGCTGAAGA

TTTGGGAGTTTATTACTGC (amino acids)
                                                          (SEQ ID NO: 919)
GVPDRFSGSGSGTDFTLKISRVEAEDLGVYYC Mouse antibody 3C5 light chain variable complementarity determining regions 3
(CDR3) sequence:
(DNA)
                                                          (SEQ ID NO: 920)
TTGCAAACTACACATTTTCCGTGGACG (amino acids)
                                                          (SEQ ID NO: 921)
LQTTHFPWT Mouse antibody 3C5 light chain variable framework 4 (FW4) sequence:
(DNA)
                                                          (SEQ ID NO: 922)
TTCGGTGGAGGCACCAAGCTGGAAATCAAA (amino acids)
                                                          (SEQ ID NO: 923)
FGGGTKLEIK Mouse antibody 8A9 Heavy chain: DNA sequence (420 bp)
Signal sequence-FR1-CDR1-FR2-CDR2-FR3-CDR3-FR4
                                                          (SEQ ID NO: 924)
ATGAAGTTGTGGCTGAACTGGATTTTCCTTGTAACACTTTTAAATGGTATCCAGTGTGAGGTGGAGCTGGTGGAGTC

TGGAGGAGGCTTGGTACAGCCTGGGGGTTCTCTGAGACTCTCCTGTGCAACTTCTGGGTTCACCTTCACTGATCACT

ACATGAGCTGGGTCCGCCAGCCTCCAGGAAAGGCACTTGAGTGGTTGGGATTTATTAGAAACAAAGCTAATGGTTAC

ACAACAGAGTACAGTGCATCTGTGAAGGGTCGGTTCACCATCTCCAGAGATAATTCCCAAAGCATCCTCTATCTTCA

AATGAAAACCCTGAGAACTGAGGACAGTGCCACTTATTACTGTGCAAGACCTTCTGACTGGGACTCCTGGTTTGCTT

ACTGGGGCCAAGGGACTCTGGTCACTGTCTCTGCA

Mouse antibody 8A9 Heavy chain: Amino acid sequence (140 aa)
Signal peptide-FR1-CDR1-FR2-CDR2-FR3-CDR3-FR4
                                                          (SEQ ID NO: 925)
MKLWLNWIFLVTLLNGIQCEVELVESGGGLVQPGGSLRLSCATSGFTFTDHYMSWVRQPPGKALEWLGFIRNKANGY

TTEYSASVKGRFTISRDNSQSILYLQMKTLRTEDSATYYCARPSDWDSWFAYWGQGTLVTVSA

Mouse antibody 8A9 heavy chain variable framework 1 (FW1) sequence:
(DNA)
                                                          (SEQ ID NO: 926)
GAGGTGGAGCTGGTGGAGTCTGGAGGAGGCTTGGTACAGCCTGGGGGTTCTCTGAGACTCTCCTGTGCAACTTCTGG

GTTCACCTTCACT (amino acids)
                                                          (SEQ ID NO: 927)
EVELVESGGGLVQPGGSLRLSCATSGFTFT Mouse antibody 8A9 heavy chain variable complementarity determining regions 1
(CDR1) sequence:
(DNA)
                                                          (SEQ ID NO: 928)
GATCACTACATGAGC (amino acids)
                                                          (SEQ ID NO: 929)
DHYMS -continued Mouse antibody 8A9 heavy chain variable framework 2 (FW2) sequence:
(DNA)

(SEQ ID NO: 930)

TGGGTCCGCCAGCCTCCAGGAAAGGCACTTGAGTGGTTGGGA (amino acids)

(SEQ ID NO: 931)

WVRQPPGKALEWLG

Mouse antibody 8A9 heavy chain variable complementarity determining regions 2
(CDR2) sequence:
(DNA)

(SEQ ID NO: 932)

TTTATTAGAAACAAAGCTAATGGTTACACAACAGAGTACAGTGCATCTGTGAAGGGT (amino acids)

(SEQ ID NO: 933)

FIRNKANGYTTEYSASVKG

Mouse antibody 8A9 heavy chain variable framework 3 (FW3) sequence:
(DNA)

(SEQ ID NO: 934)

CGGTTCACCATCTCCAGAGATAATTCCCAAAGCATCCTCTATCTTCAAATGAAAACCCTGAGAACTGAGGACAGTGC

CACTTATTACTGTGCAAGA (amino acids)

(SEQ ID NO: 935)

RFTISRDNSQSILYLQMKTLRTEDSATYYCAR

Mouse antibody 8A9 heavy chain variable complementarity determining regions 3
(CDR3) sequence:
(DNA)

(SEQ ID NO: 936)

CCTTCTGACTGGGACTCCTGGTTTGCTTAC (amino acids)

(SEQ ID NO: 937)

PSDWDSWFAY

Mouse antibody 8A9 heavy chain variable framework 4 (FW4) sequence:
(DNA)

(SEQ ID NO: 938)

TGGGGCCAAGGGACTCTGGTCACTGTCTCTGCA (amino acids)

(SEQ ID NO: 939)

WGQGTLVTVSA

Mouse antibody 8A9 Light chain: DNA sequence (393 bp)
Signal sequence-FR1-CDR1-FR2-CDR2-FR3-CDR3-FR4

(SEQ ID NO: 940)

ATGAAGTTGCCTGTTAGGCTGTTGGTGCTGATGTTCTGGATTCCTGCTTCCAGCAGTGATGTTTTGATGACCCAAAC

TCCACTCTCCCTGCCTGTCAGTCTTGGTGATCAAGCCTCCATCTCTTGCAGATCTAGTCAGAGCATTGTACATAGTA

ATGGCAACACCTATTTAGATTGGTACTTGCAGAAACCAGGCCAGTCTCCAAAGTCCTGATCTACAGAGTTTCCAAC

CGATTTTCTGGGGTCCCAGACAGGTTCAGTGGCAGTGGATCAGGGACAGATTTCACACTCAAGATCAGCAGAGTGGA

GGCTGAGGATCTGGGACTTTATTACTGTTTTCAAGGTTCACATGTTCCGTGGGCGTTCGGTGGAGGCACCAAGCTGG

AAATCAAA

Mouse antibody 8A9 Light chain: Amino acid sequence (131 aa)
Signal peptide-FR1-CDR1-FR2-CDR2-FR3-CDR3-FR4

(SEQ ID NO: 941)

MKLPVRLLVLMFWIPASSSDVLMTQTPLSLPVSLGDQASISCRSSQSIVHSNGNTYLDWYLQKPGQSPKLLIYRVSN
RFSGVPDRFSGSGSGTDFTLKISRVEAEDLGLYYCFQGSHVPWAFGGGTKLEIK

Mouse antibody 8A9 light chain variable framework 1 (FW1) sequence:
(DNA)

(SEQ ID NO: 942)

GATGTTTTGATGACCCAAACTCCACTCTCCCTGCCTGTCAGTCTTGGTGATCAAGCCTCCATCTCTTGC (amino acids)

(SEQ ID NO: 943)

DVLMTQTPLSLPVSLGDQASISC

-continued

Mouse antibody 8A9 light chain variable complementarity determining regions 1
(CDR1) sequence:
(DNA)
(SEQ ID NO: 944)
AGATCTAGTCAGAGCATTGTACATAGTAATGGCAACACCTATTTAGAT (amino acids)
(SEQ ID NO: 945)
RSSQSIVHSNGNTYLD Mouse antibody 8A9 light chain variable framework 2 (FW2) sequence:
(DNA)
(SEQ ID NO: 946)
TGGTACTTGCAGAAACCAGGCCAGTCTCCAAAGCTCCTGATCTAC (amino acids)
(SEQ ID NO: 947)
WYLQKPGQSPKLLIY Mouse antibody 8A9 light chain variable complementarity determining regions 2
(CDR2) sequence:
(DNA)
(SEQ ID NO: 948)
AGAGTTTCCAACCGATTTTCT (amino acids)
(SEQ ID NO: 949)
RVSNRFS Mouse antibody 8A9 light chain variable framework 3 (FW3) sequence:
(DNA)
(SEQ ID NO: 950)
GGGGTCCCAGACAGGTTCAGTGGCAGTGGATCAGGGACAGATTTCACACTCAAGATCAGCAGAGTGGAGGCTGAGGA

TCTGGGACTTTATTACTGT (amino acids)
(SEQ ID NO: 951)
GVPDRFSGSGSGTDFTLKISRVEAEDLGLYYC Mouse antibody 8A9 light chain variable complementarity determining regions 3
(CDR3) sequence:
(DNA)
(SEQ ID NO: 952)
TTTCAAGGTTCACATGTTCCGTGGGCG (amino acids)
(SEQ ID NO: 953)
FQGSHVPWA Mouse antibody 8A9 light chain variable framework 4 (FW4) sequence:
(DNA)
(SEQ ID NO: 954)
TTCGGTGGAGGCACCAAGCTGGAAATCAAA (amino acids)
(SEQ ID NO: 955)
FGGGTKLEIK Mouse antibody 18G12 Heavy chain: DNA sequence (399 bp)
Signal sequence-FR1-CDR1-FR2-CDR2-FR3-CDR3-FR4
(SEQ ID NO: 956)
ATGGGATGGAGCTATATCATCCTCTTTTTGGTCGCAACAGCTACAGGTGTCCACTCCCAGGTCCAACTGCAGCAGTC

TGGGGCTGAACTGGTGAAGCCTGGGGCTTCAGTGAAGTTGTCCTGCAAGGCTTCTGGCTACACCTTCACCGGCTACT

TTTTGTACTGGGTGAAGCAGAGGCCTGGACAAGGCCTTGAGTGGATTGGGGGGATTAATCCTGACAATGGTGGTATT

GACTTCAATGAGAAGTTCAGGAACAAGGCCACACTGACTGTAGACAAATCCTCCAGCACAGCCTACATGCAACTCAG

CAGCCTGACATCTGAGGACTCTGCGGTCTATTATTGTACATTACTAATAGGGAACTATTGGGGCCAAGGCACCACTC

TCACAGTCTCCTCA

Mouse antibody 18G12 Heavy chain: Amino acid sequence (133 aa)
Signal peptide-FR1-CDR1-FR2-CDR2-FR3-CDR3-FR4
(SEQ ID NO: 957)
MGWSYIILFLVATATGVHSQVQLQQSGAELVKPGASVKLSCKASGYTFTGYFLYWVKQRPGQGLEWIGGINPDNGGI

DFNEKERNKATLTVDKSSSTAYMQLSSLTSEDSAVYYCTLLIGNYWGQGTTLTVSS

-continued

Mouse antibody 18G12 heavy chain variable framework 1 (FW1) sequence:
(DNA)
(SEQ ID NO: 958)
CAGGTCCAACTGCAGCAGTCTGGGGCTGAACTGGTGAAGCCTGGGGCTTCAGTGAAGTTGTCCTGCAAGGCTTCTGG

CTACACCTTCACC (amino acids)
(SEQ ID NO: 959)
QVQLQQSGAELVKPGASVKLSCKASGYTFT

Mouse antibody 39H5 heavy chain variable complementarity determining regions
1 (CDR1) sequence:
(DNA)
(SEQ ID NO: 960)
GGCTACTTTTTGTAC (amino acids)
(SEQ ID NO: 961)
GYFLY Mouse antibody 18G12 heavy chain variable framework 2 (FW2) sequence:
(DNA)
(SEQ ID NO: 962)
TGGGTGAAGCAGAGGCCTGGACAAGGCCTTGAGTGGATTGGG (amino acids)
(SEQ ID NO: 963)
WVKQRPGQGLEWIG Mouse antibody 18G12 heavy chain variable complementarity determining regions
2 (CDR2) sequence:
(DNA)
(SEQ ID NO: 964)
GGGATTAATCCTGACAATGGTGGTATTGACTTCAATGAGAAGTTCAGGAAC (amino acids)
(SEQ ID NO: 965)
GINPDNGGIDFNEKERN Mouse antibody 18G12 heavy chain variable framework 3 (FW3) sequence:
(DNA)
(SEQ ID NO: 966)
AAGGCCACACTGACTGTAGACAAATCCTCCAGCACAGCCTACATGCAACTCAGCAGCCTGACATCTGAGGACTCTGC

GGTCTATTATTGTACATTA (amino acids)
(SEQ ID NO: 967)
KATLTVDKSSSTAYMQLSSLTSEDSAVYYCTL Mouse antibody 18G12 heavy chain variable complementarity determining regions
3 (CDR3) sequence:
(DNA)
(SEQ ID NO: 968)
CTAATAGGGAACTAT (amino acids)
(SEQ ID NO: 969)
LIGNY Mouse antibody 18G12 heavy chain variable framework 4 (FW4) sequence:
(DNA)
(SEQ ID NO: 970)
TGGGGCCAAGGCACCACTCTCACAGTCTCCTCA (amino acids)
(SEQ ID NO: 971)
WGQGTTLTVSS Mouse antibody 18G12 Light chain: DNA sequence (393 bp)
Signal sequence-FR1-CDR1-FR2-CDR2-FR3-CDR3-FR4
(SEQ ID NO: 972)
ATGAGTCCTGCCCAGTTCCTGTTTCTGTTAGTGCTCTGGATTCGGGAAACCAATGGTGATGTTGTGATGACCCAGAC

TCCACTCACTTTGTCGGTAACCATTGGACAGCCAGCCTCCATCTCTTGCAAGTCAAGTCAGAGCCTCTTACATAGTG

ATGGAAAGACATATTTGATTTGGTTGTTACAGAGGCCAGGCCAGTCTCCAAAGCGCCTAATCTATCTGGTGTCTAAA

CTGGACTCTGGAGTCCCTGACAGGTTCACTGGCAGTGGATCAGGGACAGATTTCACACTGAAAATCAGCAGAGTGGA

GGCTGAGGATTTGGGAGTTTATTTTTGCTGTCAAGGTACACATTTTCCGTGGACGTTCGGTGGAGGCACCATGCTGG

AAATCAAA

Mouse antibody 18G12 Light chain: Amino acid sequence (131 aa)
Signal peptide-FR1-CDR1-FR2-CDR2-FR3-CDR3-FR4
                                                              (SEQ ID NO: 973)
MSPAQFLFLLVLWIRETNGDVVMTQTPLTLSVTIGQPASISCKSSQSLLHSDGKTYLIWLLQRPGQSPKRLIYLVSK

LDSGVPDRFTGSGSGTDFTLKISRVEAEDLGVYFCCQGTHFPWTFGGGTMLEIK

Mouse antibody 18G12 light chain variable framework 1 (FW1) sequence:
(DNA)
                                                              (SEQ ID NO: 974)
GATGTTGTGATGACCCAGACTCCACTCACTTTGTCGGTAACCATTGGACAGCCAGCCTCCATCTCTTGC (amino acids)
                                                              (SEQ ID NO: 975)
DVVMTQTPLTLSVTIGQPASISC Mouse antibody 18G12 light chain variable complementarity determining regions
1 (CDR1) sequence:
(DNA)
                                                              (SEQ ID NO: 976)
AAGTCAAGTCAGAGCCTCTTACATAGTGATGGAAAGACATATTTGATT (amino acids)
                                                              (SEQ ID NO: 977)
KSSQSLLHSDGKTYLI Mouse antibody 18G12 light chain variable framework 2 (FW2) sequence:
(DNA)
                                                              (SEQ ID NO: 978)
TGGTTGTTACAGAGGCCAGGCCAGTCTCCAAAGCGCCTAATCTAT (amino acids)
                                                              (SEQ ID NO: 979)
WLLQRPGQSPKRLIY Mouse antibody 18G12 light chain variable complementarity determining regions
2 (CDR2) sequence:
(DNA)
                                                              (SEQ ID NO: 980)
CTGGTGTCTAAACTGGACTCT (amino acids)
                                                              (SEQ ID NO: 981)
LVSKLDS Mouse antibody 18G12 light chain variable framework 3 (FW3) sequence:
(DNA)
                                                              (SEQ ID NO: 982)
GGAGTCCCTGACAGGTTCACTGGCAGTGGATCAGGGACAGATTTCACACTGAAAATCAGCAGAGTGGAGGCTGAGGA

TTTGGGAGTTTATTTTTGC (amino acids)
                                                              (SEQ ID NO: 983)
GVPDRFTGSGSGTDFTLKISRVEAEDLGVYFC Mouse antibody 18G12 light chain variable complementarity determining regions
3 (CDR3) sequence:
(DNA)
                                                              (SEQ ID NO: 984)
TGTCAAGGTACACATTTTCCGTGGACG (amino acids)
                                                              (SEQ ID NO: 985)
CQGTHFPWT Mouse antibody 18G12 light chain variable framework 4 (FW4) sequence:
(DNA)
                                                              (SEQ ID NO: 986)
TTCGGTGGAGGCACCATGCTGGAAATCAAA (amino acids)
                                                              (SEQ ID NO: 987)
FGGGTMLEIK -continued Mouse antibody 20A10 Heavy chain: DNA sequence (417 bp)
Signal sequence-FR1-CDR1-FR2-CDR2-FR3-CDR3-FR4
                                                          (SEQ ID NO: 988)
ATGAACTTCGGGTTCAGCTTGATTTTCCTTGTCCTTGTTTTAAAAGGTGTCCAGTGTGAAGTGATGCTGGTGGAGTC

TGGGGGAGGCTTAGTGAAGCCTGGAGGGTCCCTGAAACTCTCCTGTCAGCCTCTGGATTCACTTTCAGTACCTATGC

CATGTCTTGGATTCGCCAGACTCCAGAGAAGAGGCTGGAGTGGGTCGCATCCATTGGTCGTGCTGGTTCCACCTACT

ATTCAGACAGTGTGAAGGGCCGATTCACCATCTCCAGAGATAATGTCCGGAACATCCTGTACCTGCAAATGAGCAGT

CTGAGGTCTGAGGACACGGCCATGTATTACTGTGCTAGAGGCCCGATCTACAATGATTACGACGAGTTTGCTTACTG

GGGCCAAGGGACTCTGGTCACTGTCTCTGCA

Mouse antibody 20A10 Heavy chain: Amino acid sequence (139 aa)
Signal peptide-FR1-CDR1-FR2-CDR2-FR3-CDR3-FR4
                                                          (SEQ ID NO: 989)
MNFGESLIFLVLVLKGVQCEVMLVESGGGLVKPGGSLKLSCAASGFTESTYAMSWIRQTPEKRLEWVASIGRAGSTY

YSDSVKGRFTISRDNVRNILYLQMSSLRSEDTAMYYCARGPIYNDYDEFAYWGQGTLVTVSA

Mouse antibody 20A10 heavy chain variable framework 1 (FW1) sequence:
(DNA)
                                                          (SEQ ID NO: 990)
GAAGTGATGCTGGTGGAGTCTGGGGGAGGCTTAGTGAAGCCTGGAGGGTCCCTGAAACTCTCCTGTGCAGCCTCTGG
ATTCACTTTCAGT (amino acids)
                                                          (SEQ ID NO: 991)
EVMLVESGGGLVKPGGSLKLSCAASGFTFS Mouse antibody 20A10 heavy chain variable complementarity determining regions
1 (CDR1) sequence:
(DNA)
                                                          (SEQ ID NO: 992)
ACCTATGCCATGTCT (amino acids)
                                                          (SEQ ID NO: 993)
TYAMS Mouse antibody 20A10 heavy chain variable framework 2 (FW2) sequence:
(DNA)
                                                          (SEQ ID NO: 994)
TGGATTCGCCAGACTCCAGAGAAGAGGCTGGAGTGGGTCGCA (amino acids)
                                                          (SEQ ID NO: 995)
WIRQTPEKRLEWVA Mouse antibody 20A10 heavy chain variable complementarity determining regions
2 (CDR2) sequence:
(DNA)
                                                          (SEQ ID NO: 996)
TCCATTGGTCGTGCTGGTTCCACCTACTATTCAGACAGTGTGAAGGGC (amino acids)
                                                          (SEQ ID NO: 997)
SIGRAGSTYYSDSVKG Mouse antibody 20A10 heavy chain variable framework 3 (FW3) sequence:
(DNA)
                                                          (SEQ ID NO: 998)
CGATTCACCATCTCCAGAGATAATGTCCGGAACATCCTGTACCTGCAAATGAGCAGTCTGAGGTCTGAGGACACGGC

CATGTATTACTGTGCTAGA (amino acids)
                                                          (SEQ ID NO: 999)
RFTISRDNVRNILYLQMSSLRSEDTAMYYCAR Mouse antibody 20A10 heavy chain variable complementarity determining regions
3 (CDR3) sequence:
(DNA)
                                                          (SEQ ID NO: 1000)
GGCCCGATCTACAATGATTACGACGAGTTTGCTTAC -continued (amino acids)

(SEQ ID NO: 1001)

GPIYNDYDEFAY

Mouse antibody 20A10 heavy chain variable framework 4 (FW4) sequence:
(DNA)

(SEQ ID NO: 1002)

TGGGGCCAAGGGACTCTGGTCACTGTCTCTGCA (amino acids)

(SEQ ID NO: 1003)

WGQGTLVTVSA

Mouse antibody 20A10 Light chain: DNA sequence (396 bp)
Signal sequence-FR1-CDR1-FR2-CDR2-FR3-CDR3-FR4

(SEQ ID NO: 1004)

ATGGAATCACAGACTCAGGTCTTCCTCTCCCTGCTGCTCTGGGTATCTGGTACCTGTGGGAACATTATGATGACACA

GTCGCCATCATCTCTGGCTGTGTCTGCAGGAGAAAAGGTCACTATGAGCTGTAAGTCCAGTCAAAGTGTTTTATACA

GTTCAAATCAGAAGAACTATTTGGCCTGGTACCAGCAGAAACCAGGGCAGTCTCCTAAACTGCTGATCTACTGGGCA

TCCACTAGGGAATCTGGTGTCCCTGATCGCTTCACAGGCAGTGGATCTGGGACAGATTTTACTCTTACCATCAGCAG

TGTACAAGCTGAAGACCTGGCAGTTTATTACTGTCATCAATACCTCTCCTCGCTCACGTTCGGTGCTGGGACCAAGC

TGGAGCTGAAA

Mouse antibody 20A10 Light chain: Amino acid sequence (132 aa)
Signal peptide-FR1-CDR1-FR2-CDR2-FR3-CDR3-FR4

(SEQ ID NO: 1005)

MESQTQVFLSLLLWVSGTCGNIMMTQSPSSLAVSAGEKVTMSCKSSQSVLYSSNQKNYLAWYQQKPGQSPKLLIYWA

STRESGVPDRFTGSGSGTDFTLTISSVQAEDLAVYYCHQYLSSLTFGAGTKLELK

Mouse antibody 20A10 light chain variable framework 1 (FW1) sequence:
(DNA)

(SEQ ID NO: 1006)

AACATTATGATGACACAGTCGCCATCATCTCTGGCTGTGTCTGCAGGAGAAAAGGTCACTATGAGCTGT (amino acids)

(SEQ ID NO: 1007)

NIMMTQSPSSLAVSAGEKVTMSC

Mouse antibody 20A10 light chain variable complementarity determining regions
1 (CDR1) sequence:
(DNA)

(SEQ ID NO: 1008)

AAGTCCAGTCAAAGTGTTTTATACAGTTCAAATCAGAAGAACTATTTGGCC (amino acids)

(SEQ ID NO: 1009)

KSSQSVLYSSNQKNYLA

Mouse antibody 20A10 light chain variable framework 2 (FW2) sequence:
(DNA)

(SEQ ID NO: 1010)

TGGTACCAGCAGAAACCAGGGCAGTCTCCTAAACTGCTGATCTAC (amino acids)

(SEQ ID NO: 1011)

WYQQKPGQSPKLLIY

Mouse antibody 20A10 light chain variable complementarity determining regions
2 (CDR2) sequence:
(DNA)

(SEQ ID NO: 1012)

TGGGCATCCACTAGGGAATCT (amino acids)

(SEQ ID NO: 1013)

WASTRES

Mouse antibody 20A10 light chain variable framework 3 (FW3) sequence:
(DNA)

(SEQ ID NO: 1014)

GGTGTCCCTGATCGCTTCACAGGCAGTGGATCTGGGACAGATTTTACTCTTACCATCAGCAGTGTACAAGCTGAAGA

CCTGGCAGTTTATTACTGT

-continued (amino acids)

(SEQ ID NO: 1015)

GVPDRFTGSGSGTDFTLTISSVQAEDLAVYYC

Mouse antibody 20A10 light chain variable complementarity determining regions
3 (CDR3) sequence:
(DNA)

(SEQ ID NO: 1016)

CATCAATACCTCTCCTCGCTCACG (amino acids)

(SEQ ID NO: 1017)

HQYLSSLT

Mouse antibody 20A10 light chain variable framework 4 (FW4) sequence:
(DNA)

(SEQ ID NO: 1018)

TTCGGTGCTGGGACCAAGCTGGAGCTGAAA (amino acids)

(SEQ ID NO: 1019)

FGAGTKLELK

Mouse antibody 25E6 Heavy chain: DNA sequence (414 bp)
Signal sequence-FR1-CDR1-FR2-CDR2-FR3-CDR3-FR4

(SEQ ID NO: 1020)

ATGAACTTCGGGCTCAGCTTGATTTTCCTTGCCCTCATTTTAAAAGGTGTCCAGTGTGAGGTGCAGCTGGTGGAGTC

TGGGGGAGACTTAGTGAAGCCTGGAGGGTCCCTGAAACTCTCCTGTGCAGCCTCTGGTTTCACTTTCAGTAGTTATG

GAATGTCTTGGGTTCGCCAGACTCCAGACAAGAGGCTGGAGTGGGTCGCAACCATTAGTAATGGTGGTAGACACACC

TTCTATCCAGACAGTGTGAAGGGGCGATTCACCATCTCCAGAGACAATGCCAAGAACACCCTGTATCTGCAAATGAG

CAGTCTGAAGTTGAGGACACAGCCATGTATTTATGTGTAAGACAGACTGGGACGGAGGGCTGGTTTGCTTACTGGGG

CCAAGGGACTCTGGTCACTGTCTCTGCA

Mouse antibody 25E6 Heavy chain: Amino acid sequence (138 aa)
Signal peptide-FR1-CDR1-FR2-CDR2-FR3-CDR3-FR4

(SEQ ID NO: 1021)

MNFGLSLIFLALILKGVQCEVQLVESGGDLVKPGGSLKLSCAASGFTESSYGMSWVRQTPDKRLEWVATISNGGRHT

FYPDSVKGRFTISRDNAKNTLYLQMSSLKSEDTAMYLCVRQTGTEGWFAYWGQGTLVTVSA

Mouse antibody 25E6 heavy chain variable framework 1 (FW1) sequence:
(DNA)

(SEQ ID NO: 1022)

GAGGTGCAGCTGGTGGAGTCTGGGGGAGACTTAGTGAAGCCTGGAGGGTCCCTGAAACTCTCCTGTGCAGCCTCTGG

TTTCACTTTCAGT (amino acids)

(SEQ ID NO: 1023)

EVQLVESGGDLVKPGGSLKLSCAASGFTFS

Mouse antibody 25E6 heavy chain variable complementarity determining regions
1 (CDR1) sequence:
(DNA)

(SEQ ID NO: 1024)

AGTTATGGAATGTCT (amino acids)

(SEQ ID NO: 1025)

SYGMS

Mouse antibody 25E6 heavy chain variable framework 2 (FW2) sequence:
(DNA)

(SEQ ID NO: 1026)

TGGGTTCGCCAGACTCCAGACAAGAGGCTGGAGTGGGTCGCA (amino acids)

(SEQ ID NO: 1027)

WVRQTPDKRLEWVA

Mouse antibody 25E6 heavy chain variable complementarity determining regions
2 (CDR2) sequence:
(DNA)

(SEQ ID NO: 1028)

ACCATTAGTAATGGTGGTAGACACACCTTCTATCCAGACAGTGTGAAGGGG

-continued (amino acids)
                                                                        (SEQ ID NO: 1029)
TISNGGRHTFYPDSVKG Mouse heavy chain variable framework 3 (FW3) sequence:
(DNA)
                                                                        (SEQ ID NO: 1030)
CGATTCACCATCTCCAGAGACAATGCCAAGAACACCCTGTATCTGCAAATGAGCAGTCTGAAGTCTGAGGACACAGC
CATGTATTTATGTGTAAGA (amino acids)
                                                                        (SEQ ID NO: 1031)
RFTISRDNAKNTLYLQMSSLKSEDTAMYLCVR Mouse antibody 25E6 heavy chain variable complementarity determining regions
3 (CDR3) sequence:
(DNA)
                                                                        (SEQ ID NO: 1032)
CAGACTGGGACGGAGGGCTGGTTTGCTTAC (amino acids)
                                                                        (SEQ ID NO: 1033)
QTGTEGWFAY Mouse antibody 25E6 heavy chain variable framework 4 (FW4) sequence:
(DNA)
                                                                        (SEQ ID NO: 1034)
TGGGGCCAAGGGACTCTGGTCACTGTCTCTGCA (amino acids)
                                                                        (SEQ ID NO: 1035)
WGQGTLVTVSA Mouse antibody 25E6 Light chain: DNA sequence (393 bp)
Signal sequence-FR1-CDR1-FR2-CDR2-FR3-CDR3-FR4
                                                                        (SEQ ID NO: 1036)
ATGAGTCCTGCCCAGTTCCTGTTTCTGTTAGTGCTCTGGATTCGGGAAACCAACGGTGATGTTGTGATGACCCAGAC

TCCACTCACTTTGTCGGTTACCATTGGACAACCAGCCTCCATCTCTTGCAAGTCAAGTCAGAGCCTCTTAGATAGTG

ATGGAAAGACATATTTGAATTGGTTGTTACAGAGGCCAGGCCAGTCTCCAAAGCGCCTAATCTATCTGGTGTCTAAA

CTGGACTCTGGAGTCCCTGACAGGTTCACTGGCAGTGGATCAGGGACAGATTTCACACTGAAAATCAGCAGAGGGAG

GCTGAGGATTTGGGAGTTTATTATTGCTGGCAAGGTACACATTTTCCTCAGACGTTCGGTGGAGGCACCAAGCTGGA

AATCAAA

Mouse antibody 25E6 Light chain: Amino acid sequence (131 aa)
Signal peptide-FR1-CDR1-FR2-CDR2-FR3-CDR3-FR4
                                                                        (SEQ ID NO: 1037)
MSPAQFLELLVLWIRETNGDVVMTQTPLTLSVTIGQPASISCKSSQSLLDSDGKTYLNWLLQRPGQSPKRLIYLVSK

LDSGVPDRFTGSGSGTDFTLKISRVEAEDLGVYYCWQGTHFPQTEGGGTKLEIK

Mouse antibody 25E6 light chain variable framework 1 (FW1) sequence:
(DNA)
                                                                        (SEQ ID NO: 1038)
GATGTTGTGATGACCCAGACTCCACTCACTTTGTCGGTTACCATTGGACAACCAGCCTCCATCTCTTGC (amino acids)
                                                                        (SEQ ID NO: 1039)
DVVMTQTPLTLSVTIGQPASISC Mouse antibody 25E6 light chain variable complementarity determining regions
1 (CDR1) sequence:
(DNA)
                                                                        (SEQ ID NO: 1040)
AAGTCAAGTCAGAGCCTCTTAGATAGTGATGGAAAGACATATTTGAAT (amino acids)
                                                                        (SEQ ID NO: 1041)
KSSQSLLDSDGKTYLN Mouse antibody 25E6 light chain variable framework 2 (FW2) sequence:
(DNA)
                                                                        (SEQ ID NO: 1042)
TGGTTGTTACAGAGGCCAGGCCAGTCTCCAAAGCGCCTAATCTAT -continued (amino acids)
                                                    (SEQ ID NO: 1043)
WLLQRPGQSPKRLIY Mouse antibody 25E6 light chain variable complementarity determining regions
2 (CDR2) sequence:
(DNA)
                                                    (SEQ ID NO: 1044)
CTGGTGTCTAAACTGGACTCT (amino acids)
                                                    (SEQ ID NO: 1045)
LVSKLDS Mouse antibody 25E6 light chain variable framework 3 (FW3) sequence:
(DNA)
                                                    (SEQ ID NO: 1046)
GGAGTCCCTGACAGGTTCACTGGCAGTGGATCAGGGACAGATTTCACACTGAAAATCAGCAGAGTGGAGGCTGAGGA

TTTGGGAGTTTATTATTGC (amino acids)
                                                    (SEQ ID NO: 1047)
GVPDRFTGSGSGTDFTLKISRVEAEDLGVYYC Mouse antibody 25E6 light chain variable complementarity determining regions
3 (CDR3) sequence:
(DNA)
                                                    (SEQ ID NO: 1048)
TGGCAAGGTACACATTTTCCTCAGACG (amino acids)
                                                    (SEQ ID NO: 1049)
WQGTHFPQT Mouse antibody 25E6 light chain variable framework 4 (FW4) sequence:
(DNA)
                                                    (SEQ ID NO: 1050)
TTCGGTGGAGGCACCAAGCTGGAAATCAAA (amino acids)
                                                    (SEQ ID NO: 1051)
FGGGTKLEIK Mouse antibody 28F9 Heavy chain: DNA sequence (399 bp)
Signal sequence-FR1-CDR1-FR2-CDR2-FR3-CDR3-FR4
                                                    (SEQ ID NO: 1052)
ATGGGATGGAGCTATATCATCCTCTTTTTGGTAGCAACAGCTACAGGTGTCCACTCCCAGGTCCAACTGCAGCAGCC

TGGGGCTGAACTGGTGCAGCCTGGGGCTTCAGTGAAGTTGTCCTGCAAGGCTTCTGGCTACACCTTCACCGGCTACT

TTTTGTACTGGGTGAAGCAGAGGCCTGGACATGGCCTTGAGTGGATTGGGGGAATTCATCCTAGCAATGGTGATACT

GACTTCAATGAGAAGTTCAAGAACAAGGCCACACTGACTGTAGACATATCCTCCAGCACTGCCTACATGCAACTCAG

CAGCCTGACATCTGAGGACTCTGCGGTCTATTATTGTACATTACTAATAGGGGTCTACTGGGGCCAAGGCACCACTC

TCACAGTCTCCTCA

Mouse antibody 28F9 Heavy chain: Amino acid sequence (133 aa)
Signal peptide-FR1-CDR1-FR2-CDR2-FR3-CDR3-FR4
                                                    (SEQ ID NO: 1053)
MGWSYIILFLVATATGVHSQVQLQQPGAELVQPGASVKLSCKASGYTFTGYFLYWVKQRPGHGLEWIGGIHPSNGDT

DFNEKEKNKATLTVDISSSTAYMQLSSLTSEDSAVYYCTLLIGVYWGQGTTLTVSS

Mouse antibody 28F9 heavy chain variable framework 1 (FW1) sequence:
(DNA)
                                                    (SEQ ID NO: 1054)
CAGGTCCAACTGCAGCAGCCTGGGGCTGAACTGGTGCAGCCTGGGGCTTCAGTGAAGTTGTCCTGCAAGGCTTCTGG

CTACACCTTCACC (amino acids)
                                                    (SEQ ID NO: 1055)
QVQLQQPGAELVQPGASVKLSCKASGYTFT -continued Mouse antibody 28F9 heavy chain variable complementarity determining regions
1 (CDR1) sequence:
(DNA)
(SEQ ID NO: 1056)
GGCTACTTTTTGTAC (amino acids)
(SEQ ID NO: 1057)
GYFLY Mouse antibody 28F9 heavy chain variable framework 2 (FW2) sequence:
(DNA)
(SEQ ID NO: 1058)
TGGGTGAAGCAGAGGCCTGGACATGGCCTTGAGTGGATTGGG (amino acids)
(SEQ ID NO: 1059)
WVKQRPGHGLEWIG Mouse antibody 28F9 heavy chain variable complementarity determining regions
2 (CDR2) sequence:
(DNA)
(SEQ ID NO: 1060)
GGAATTCATCCTAGCAATGGTGATACTGACTTCAATGAGAAGTTCAAGAAC (amino acids)
(SEQ ID NO: 1061)
GIHPSNGDTDFNEKFKN Mouse antibody 28F9 heavy chain variable framework 3 (FW3) sequence:
(DNA)
(SEQ ID NO: 1062)
AAGGCCACACTGACTGTAGACATATCCTCCAGCACTGCCTACATGCAACTCAGCAGCCTGACATCTGAGGACTCTGC

GGTCTATTATTGTACATTA (amino acids)
(SEQ ID NO: 1063)
KATLTVDISSSTAYMQLSSLTSEDSAVYYCTL Mouse antibody 28F9 heavy chain variable complementarity determining regions
3 (CDR3) sequence:
(DNA)
(SEQ ID NO: 1064)
CTAATAGGGGTCTAC (amino acids)
(SEQ ID NO: 1065)
LIGVY Mouse antibody 28F9 heavy chain variable framework 4 (FW4) sequence:
(DNA)
(SEQ ID NO: 1066)
TGGGGCCAAGGCACCACTCTCACAGTCTCCTCA (amino acids)
(SEQ ID NO: 1067)
WGQGTTLTVSS Mouse antibody 28F9 Light chain: DNA sequence (393 bp)
Signal sequence-FR1-CDR1-FR2-CDR2-FR3-CDR3-FR4
(SEQ ID NO: 1068)
ATGAGTCCTGCCCAGTTCCTGTTTCTGTTAGTGCTCTGGATTCGGGAAACCAACGGTGATGTTGTGATGACCCAGAC

TCCACTCACTTTGTCGGTTACCATTGGACAACCAGCCTCCATCTCTTGCAAGTCAAGTCAGAGCCTCTTACATAGTG

ATGGAAAGACATATTTGATTTGGTTGTTACAGAGGCCAGGCCAGTCTCCAAAGCGCCTAATCTATCTGGTGTCTAAA

CTGGACTCTGGAGTCCCTGACAGGTTCACCGGCAGTGGATCAGGGACAGATTTCACACTGAAAATCAGCAGAGTGGA

GGCTGAGGATTTGGGAGTTTATTTTTGCTGTCAAGGTACACATTTTCCGTGGACGTTCGGTGGAGGCACCATGCTGG

AAATCAAA

Mouse antibody 28F9 Light chain: Amino acid sequence (131 aa)
Signal peptide-FR1-CDR1-FR2-CDR2-FR3-CDR3-FR4
(SEQ ID NO: 1069)
MSPAQFLFLLVLWIRETNGDVVMTQTPLTLSVTIGQPASISCKSSQSLLHSDGKTYLIWLLQRPGQSPKRLIYLVSK

LDSGVPDRFTGSGSGTDFTLKISRVEAEDLGVYFCCQGTHFPWTFGGGTMLEIK

-continued

Mouse antibody 28F9 light chain variable framework 1 (FW1) sequence:
(DNA)

(SEQ ID NO: 1070)

GATGTTGTGATGACCCAGACTCCACTCACTTTGTCGGTTACCATTGGACAACCAGCCTCCATCTCTTGC (amino acids)

(SEQ ID NO: 1071)

DVVMTQTPLTLSVTIGQPASISC

Mouse antibody 28F9 light chain variable complementarity determining regions
1 (CDR1) sequence:
(DNA)

(SEQ ID NO: 1072)

AAGTCAAGTCAGAGCCTCTTACATAGTGATGGAAAGACATATTTGATT (amino acids)

(SEQ ID NO: 1073)

KSSQSLLHSDGKTYLI

Mouse antibody 28F9 light chain variable framework 2 (FW2) sequence:
(DNA)

(SEQ ID NO: 1074)

TGGTTGTTACAGAGGCCAGGCCAGTCTCCAAAGCGCCTAATCTAT (amino acids)

(SEQ ID NO: 1075)

WLLQRPGQSPKRLIY

Mouse antibody 28F9 light chain variable complementarity determining regions
2 (CDR2) sequence:
(DNA)

(SEQ ID NO: 1076)

CTGGTGTCTAAACTGGACTCT (amino acids)

(SEQ ID NO: 1077)

LVSKLDS

Mouse antibody 28F9 light chain variable framework 3 (FW3) sequence:
(DNA)

(SEQ ID NO: 1078)

GGAGTCCCTGACAGGTTCACCGGCAGTGGATCAGGGACAGATTTCACACTGAAAATCAGCAGAGTGGAGGCTGAGGA

TTTGGGAGTTTATTTTTGC (amino acids)

(SEQ ID NO: 1079)

GVPDRFTGSGSGTDFTLKISRVEAEDLGVYFC

Mouse antibody 28F9 light chain variable complementarity determining regions
3 (CDR3) sequence:
(DNA)

(SEQ ID NO: 1080)

TGTCAAGGTACACATTTTCCGTGGACG (amino acids)

(SEQ ID NO: 1081)

CQGTHFPWT

Mouse antibody 28F9 light chain variable framework 4 (FW4) sequence:
(DNA)

(SEQ ID NO: 1082)

TTCGGTGGAGGCACCATGCTGGAAATCAAA (amino acids)

(SEQ ID NO: 1083)

FGGGTMLEIK

Mouse antibody 18B4 Heavy chain: DNA sequence (411 bp)
Signal sequence-FR1-CDR1-FR2-CDR2-FR3-CDR3-FR4

(SEQ ID NO: 1084)

ATGTACTTGGGACTGAACTATGTATTCATAGTTTTTCTCTTAAATGGTGTCCAGAGTGAAGTGAAACTTGAGGAGTC

TGGAGGAGGCTTGGTGCAACCTGGGGGATCCATGAAACTCTCTTGTGCTGCCTCTGGATTCACTTTTAATGACGCCT

GGATGGACTGGGTCCGCCAGTCTCCAGAGAAGGGGCTTGAGTGGGTTGCTGAAATTAGAAGCACAGCTAATATTCAT

-continued

ACAACATACTATGCTGAGTCTGTCCAAGGGAGGTTCACCATCTCAAGAGATGATTCCAAAAGTAGTGTCTACCTGCA

AATGAACAGCTTGAGAGCTGAAGACACTGGCATTTATTATTGTACCCCATTACTCTACGGATTTGCTTACTGGGGCC

AAGGGACTCTGGTCACTGTCTCTGCA

Mouse antibody 18B4 Heavy chain: Amino acid sequence (137 aa)
Signal peptide-FR1-CDR1-FR2-CDR2-FR3-CDR3-FR4
                                                        (SEQ ID NO: 1085)
MYLGLNYVFIVFLLNGVQSEVKLEESGGGLVQPGGSMKLSCAASGFTFNDAWMDWVRQSPEKGLEWVAEIRSTANIH

TTYYAESVQGRFTISRDDSKSSVYLQMNSLRAEDTGIYYCTPLLYGFAYWGQGTLVTVSA

Mouse antibody 18B4 heavy chain variable framework 1 (FW1) sequence:
(DNA)
                                                        (SEQ ID NO: 1086)
GAAGTGAAACTTGAGGAGTCTGGAGGAGGCTTGGTGCAACCTGGGGGATCCATGAAACTCTCTTGTGCTGCCTCTGG

ATTCACTTTTAAT (amino acids)
                                                        (SEQ ID NO: 1087)
EVKLEESGGGLVQPGGSMKLSCAASGFTFN Mouse antibody 18B4 heavy chain variable complementarity determining regions
1 (CDR1) sequence:
(DNA)
                                                        (SEQ ID NO: 1088)
GACGCCTGGATGGAC (amino acids)
                                                        (SEQ ID NO: 1089)
DAWMD Mouse antibody 18B4 heavy chain variable framework 2 (FW2) sequence:
(DNA)
                                                        (SEQ ID NO: 1090)
TGGGTCCGCCAGTCTCCAGAGAAGGGGCTTGAGTGGGTTGCT (amino acids)
                                                        (SEQ ID NO: 1091)
WVRQSPEKGLEWVA Mouse antibody 18B4 heavy chain variable complementarity determining regions
2 (CDR2) sequence:
(DNA)
                                                        (SEQ ID NO: 1092)
GAAATTAGAAGCACAGCTAATATTCATACAACATACTATGCTGAGTCTGTCCAAGGG (amino acids)
                                                        (SEQ ID NO: 1093)
EIRSTANIHTTYYAESVQG Mouse antibody 18B4 heavy chain variable framework 3 (FW3) sequence:
(DNA)
                                                        (SEQ ID NO: 1094)
AGGTTCACCATCTCAAGAGATGATTCCAAAAGTAGTGTCTACCTGCAAATGAACAGCTTGAGAGCTGAAGACACTGG

CATTTATTATTGTACCCCA (amino acids)
                                                        (SEQ ID NO: 1095)
RFTISRDDSKSSVYLQMNSLRAEDTGIYYCTP Mouse antibody 18B4 heavy chain variable complementarity determining regions
3 (CDR3) sequence:
(DNA)
                                                        (SEQ ID NO: 1096)
TTACTCTACGGATTTGCTTAC (amino acids)
                                                        (SEQ ID NO: 1097)
LLYGFAY Mouse antibody 18B4 heavy chain variable framework 4 (FW4) sequence:
(DNA)
                                                        (SEQ ID NO: 1098)
TGGGGCCAAGGGACTCTGGTCACTGTCTCTGCA -continued (amino acids)
                                                        (SEQ ID NO: 1099)
WGQGTLVTVSA Mouse antibody 18B4 Light chain: DNA sequence (393 bp)
Signal sequence-FR1-CDR1-FR2-CDR2-FR3-CDR3-FR4
                                                        (SEQ ID NO: 1100)
ATGAAGTTGCCTGTTAGGCTGTTGGTGCTGATGTTCTGGATTCCTGCTTCCAGCAGTGATGTTGTGATGACCCAAAG

TCCACTCTCCCTGCCTGTCAGTCTTGGAGATCAAGCCTCCATCTCTTGCAGAACTAGTCAGAGCCTTGTACACAGTA

ATGGAAACACCTATTTACATTGGCACCTGCAGAAGCCAGGCCAGTCTCCAAAGGTCCTGATCTACAAAGTTTCCAGC

CGATTTTCTGGGGTCCCAGACAGGTTCAGTGGCAGTGGATCGGGGACAGATTTCACACTCAAGATCAGCAGAGTGGA

GGCTGAGGATCTGGGAGTTTATTTCTGCTCTCAAAATACACATGTTCCGTACACGTTCGGAGGGGGGACCAAGCTGG

AAATAAAA

Mouse antibody 18B4 Light chain: Amino acid sequence (131 aa)
Signal peptide-FR1-CDR1-FR2-CDR2-FR3-CDR3-FR4
                                                        (SEQ ID NO: 1101)
MKLPVRLLVLMFWIPASSSDVVMTQSPLSLPVSLGDQASISCRTSQSLVHSNGNTYLHWHLQKPGQSPKVLIYKVSS

RFSGVPDRFSGSGSGTDFTLKISRVEAEDLGVYFCSQNTHVPYTFGGGTKLEIK

Mouse antibody 18B4 light chain variable framework 1 (FW1) sequence:
(DNA)
                                                        (SEQ ID NO: 1102)
GATGTTGTGATGACCCAAAGTCCACTCTCCCTGCCTGTCAGTCTTGGAGATCAAGCCTCCATCTCTTGC (amino acids)
                                                        (SEQ ID NO: 1103)
DVVMTQSPLSLPVSLGDQASISC Mouse antibody 18B4 light chain variable complementarity determining regions
1 (CDR1) sequence:
(DNA)
                                                        (SEQ ID NO: 1104)
AGAACTAGTCAGAGCCTTGTACACAGTAATGGAAACACCTATTTACAT (amino acids)
                                                        (SEQ ID NO: 1105)
RTSQSLVHSNGNTYLH Mouse antibody 18B4 light chain variable framework 2 (FW2) sequence:
(DNA)
                                                        (SEQ ID NO: 1106)
TGGCACCTGCAGAAGCCAGGCCAGTCTCCAAAGGTCCTGATCTAC (amino acids)
                                                        (SEQ ID NO: 1107)
WHLQKPGQSPKVLIY Mouse antibody 18B4 light chain variable complementarity determining regions
2 (CDR2) sequence:
(DNA)
                                                        (SEQ ID NO: 1108)
AAAGTTTCCAGCCGATTTTCT (amino acids)
                                                        (SEQ ID NO: 1109)
KVSSRFS Mouse antibody 18B4 light chain variable framework 3 (FW3) sequence:
(DNA)
                                                        (SEQ ID NO: 1110)
GGGGTCCCAGACAGGTTCAGTGGCAGTGGATCGGGGACAGATTTCACACTCAAGATCAGCAGAGTGGAGGCTGAGGA

TCTGGGAGTTTATTTCTGC (amino acids)
                                                        (SEQ ID NO: 1111)
GVPDRFSGSGSGTDFTLKISRVEAEDLGVYFC Mouse antibody 18B4 light chain variable complementarity determining regions
3 (CDR3) sequence:
(DNA)
                                                        (SEQ ID NO: 1112)
TCTCAAAATACACATGTTCCGTACACG -continued (amino acids)

(SEQ ID NO: 1113)

SQNTHVPYT

Mouse antibody 18B4 light chain variable framework 4 (FW4) sequence:
(DNA)

(SEQ ID NO: 1114)

TTCGGAGGGGGGACCAAGCTGGAAATAAAA (amino acids)

(SEQ ID NO: 1115)

FGGGTKLEIK

Mouse Antibody 1E4 Heavy chain: DNA sequence (408 bp)
Signal sequence-FR1-CDR1-FR2-CDR2-FR3-CDR3-FR4

(SEQ ID NO: 1116)

ATGGAATGGCCTTGTATCTTTCTCTTCCTCCTGTCAGTAACTGAAGGTGTCCACTCCCAGGTTCAGCTGCAGCAGTC

TGGGGCTGAGCTGGTGAGGCCTGGGTCCTCAGTGAAGATTTCCTGTAAGGCTTCTGGCTATGCATTCAGTACCTACT

GGATGAACTGGGTGAAGCAGAGGCCTGGACAGGGTCTTGAGTGGATTGGACAGATTTATCCTGGAGATAGTGATACT

AACTACAATGGAAAGTTCAAGGGTAAAGCCACACTGACTGCAGACAAGTCCTCCAACACAGCCTACATGCAGCTCAG

CAGCCTAACATCTGAGGACTCTGCGGTCTTTTTCTGTGCAAGAGGTAACCACGCCTCTATGGACTACTGGGGTCAAG

GAACCTCAGTCACCGTCTCCTCA

Mouse Antibody 1E4 Heavy chain: Amino acid sequence (136 aa)
Signal peptide-FR1-CDR1-FR2-CDR2-FR3-CDR3-FR4

(SEQ ID NO: 1117)

MEWPCIFLELLSVTEGVHSQVQLQQSGAELVRPGSSVKISCKASGYAFSTYWNWVKQRPGQGLEWIGQIYPGDSDT

NYNGKFKGKATLTADKSSNTAYMQLSSLTSEDSAVFECARGNHASMDYWGQGTSVTVSS

Mouse Antibody 1E4 heavy chain variable framework 1 (FW1) sequence:
(DNA)

(SEQ ID NO: 1118)

CAGGTTCAGCTGCAGCAGTCTGGGGCTGAGCTGGTGAGGCCTGGGTCCTCAGTGAAGATTTCCTGTAAGGCTTCTGG

CTATGCATTCAGT (amino acids)

(SEQ ID NO: 1119)

QVQLQQSGAELVRPGSSVKISCKASGYAFS

Mouse antibody 1E4 heavy chain variable complementarity determining regions 1
(CDR1) sequence:
(DNA)

(SEQ ID NO: 1200)

ACCTACTGGATGAAC (amino acids)

(SEQ ID NO: 1201)

TYWMN

Mouse antibody 1E4 heavy chain variable framework 2 (FW2) sequence:
(DNA)

(SEQ ID NO: 1202)

TGGGTGAAGCAGAGGCCTGGACAGGGTCTTGAGTGGATTGGA (amino acids)

(SEQ ID NO: 1203)

WVKQRPGQGLEWIG

Mouse antibody 1E4 heavy chain variable complementarity determining regions 2
(CDR2) sequence:
(DNA)

(SEQ ID NO: 1204)

CAGATTTATCCTGGAGATAGTGATACTAACTACAATGGAAAGTTCAAGGGT (amino acids)

(SEQ ID NO: 1205)

QTYPGDSDTNYNGKFKG

Mouse antibody 1E4 heavy chain variable framework 3 (FW3) sequence:
(DNA)

(SEQ ID NO: 1206)

AAAGCCACACTGACTGCAGACAAGTCCTCCAACACAGCCTACATGCAGCTCAGCAGCCTAACATCTGAGGACTCTGC

GGTCTTTTTCTGTGCAAGA

-continued (amino acids)
                                                        (SEQ ID NO: 1207)
KATLTADKSSNTAYMQLSSLTSEDSAVFFCAR Mouse antibody 1E4 heavy chain variable complementarity determining regions 3
(CDR3) sequence:
(DNA)
                                                        (SEQ ID NO: 1208)
GGTAACCACGCCTCTATGGACTAC (amino acids)
                                                        (SEQ ID NO: 1209)
GNHASMDY Mouse antibody 1E4 heavy chain variable framework 4 (FW4) sequence:
(DNA)
                                                        (SEQ ID NO: 1210)
TGGGGTCAAGGAACCTCAGTCACCGTCTCCTCA (amino acids)
                                                        (SEQ ID NO: 1211)
WGQGTSVTVSS Mouse Antibody 1E4 Light chain: DNA sequence (393 bp)
Signal sequence-FR1-CDR1-FR2-CDR2-FR3-CDR3-FR4
                                                        (SEQ ID NO: 1212)
ATGAAGTTGCCTGTTAGGCTGTTGGTGCTGATGTTCTGGATTCCTGCTTCCAGCAGTGATGTTGTGATGACCCAAAC

TCCACTCTCCCTGCCTGTCAGTCTTGGAGATCAAGCCTCCATCTCTTGCAGATCTAGTCAGAGCCTTGTACACAGTA

ATGGAAACACCTATTTACATTGGTACCTGCAGAAGCCAGGCCAGTCTCCAAAGCTCCTGATCTACAAAGTTTCCAAC

CGATTTTCTGGGGTCCCAGACAGGTTCAGTGGCAGTGGATCAGGGACAGATTTCACACTCAAGATCAGCAGAGTGGA

GGCTGAGGATCTGGGAGTTTATTTCTGCTCTCAAAAAACACATGTTCCGTGGACGTTCGGTGGAGGCACCAAGCTGG

AAATCAAA

Mouse Antibody 1E4 Light chain: Amino acid sequence (131 aa)
Signal peptide-FR1-CDR1-FR2-CDR2-FR3-CDR3-FR4
                                                        (SEQ ID NO: 1213)
MKLPVRLLVLMFWIPASSSDVVMTQTPLSLPVSLGDQASISCRSSQSLVHSNGNTYLHWYLQKPGQSPKLLIYKVSN

RFSGVPDRFSGSGSGTDFTLKISRVEAEDLGVYFCSQKTHVPWTEGGGTKLEIK

Mouse antibody 1E4 light chain variable framework 1 (FW1) sequence:
(DNA)
                                                        (SEQ ID NO: 1214)
GATGTTGTGATGACCCAAACTCCACTCTCCCTGCCTGTCAGTCTTGGAGATCAAGCCTCCATCTCTTGC (amino acids)
                                                        (SEQ ID NO: 1215)
DVVMTQTPLSLPVSLGDQASISC Mouse antibody 1E4 light chain variable complementarity determining regions 1
(CDR1) sequence:
(DNA)
                                                        (SEQ ID NO: 1216)
AGATCTAGTCAGAGCCTTGTACACAGTAATGGAAACACCTATTTACAT (amino acids)
                                                        (SEQ ID NO: 1217)
RSSQSLVHSNGNTYLH Mouse antibody 1E4 light chain variable framework 2 (FW2) sequence:
(DNA)
                                                        (SEQ ID NO: 1218)
TGGTACCTGCAGAAGCCAGGCCAGTCTCCAAAGCTCCTGATCTAC (amino acids)
                                                        (SEQ ID NO: 1219)
WYLQKPGQSPKLLIY Mouse antibody 1E4 light chain variable complementarity determining regions 2
(CDR2) sequence:
(DNA)
                                                        (SEQ ID NO: 1220)
AAAGTTTCCAACCGATTTTCT -continued (amino acids)

(SEQ ID NO: 1221)

KVSNRFS

Mouse antibody 1E4 light chain variable framework 3 (FW3) sequence:
(DNA)

(SEQ ID NO: 1222)

GGGGTCCCAGACAGGTTCAGTGGCAGTGGATCAGGGACAGATTTCACACTCAAGATCAGCAGAGTGGAGGCTGAGGA

TCTGGGAGTTTATTTCTGC (amino acids)

(SEQ ID NO: 1223)

GVPDRFSGSGSGTDFTLKISRVEAEDLGVYFC

Mouse antibody 1E4 light chain variable complementarity determining regions 3
(CDR3) sequence:
(DNA)

(SEQ ID NO: 1224)

TCTCAAAAAACACATGTTCCGTGGACG (amino acids)

(SEQ ID NO: 1225)

SQKTHVPWT

Mouse antibody 1E4 light chain variable framework 4 (FW4) sequence:
(DNA)

(SEQ ID NO: 1226)

TTCGGTGGAGGCACCAAGCTGGAAATCAAA (amino acids)

(SEQ ID NO: 1227)

FGGGTKLEIK

Mouse antibody 29H1 Heavy chain: DNA sequence (411 bp)
Signal sequence-FR1-CDR1-FR2-CDR2-FR3-CDR3-FR4

(SEQ ID NO: 1227)

ATGTACTTGGGACTGAACTATGTATTCATAGTTTTTCTCTTAAATGGTGTCCAGAGTGAAGTGAAGCTTGAGGAGTC

TGGAGGAGGCTTGGTACAACCTGGAGGATCCATGAAACTCTCTTGTGCTGCCTCTGGATTCACTTTTAGTGACGCCT

GGATGGACTGGGTCCGCCAGTCTCCAGAGAAGGGGCTTGAATGGGTTGCTGAAATTAGAAGCAAAGCTACTAATCAT

GCAACATACTATGCTGAGTCTGTGAAAGGGAGGTTCACCATCTCAAGAGATGATTCCAAAAGTAGTGTCTACCTGCA

AATGAACAGCTTAAGAGCTGAAGACACTGGCATTTATTACTGTACCCCCCTACTTTACGGGTTTGCTTACTGGGGCC

AAGGGACTCTGGTCACTGTCTCTGCA

Mouse antibody 29H1 Heavy chain: Amino acid sequence (137 aa)
Signal peptide-FR1-CDR1-FR2-CDR2-FR3-CDR3-FR4

(SEQ ID NO: 1229)

MYLGLNYVFIVELLNGVQSEVKLEESGGGLVQPGGSMKLSCAASGFTESDAWMDWVRQSPEKGLEWVAEIRSKATNH

ATYYAESVKGRFTISRDDSKSSVYLQMNSLRAEDTGIYYCTPLLYGFAYWGQGTLVTVSA

Mouse antibody 29H1 heavy chain variable framework 1 (FW1) sequence:
(DNA)

(SEQ ID NO: 1230)

GAAGTGAAGCTTGAGGAGTCTGGAGGAGGCTTGGTACAACCTGGAGGATCCATGAAACTCTCTTGTGCTGCCTCTGG

ATTCACTTTTAGT (amino acids)

(SEQ ID NO: 1231)

EVKLEESGGGLVQPGGSMKLSCAASGFTFS

Mouse antibody 29H1 heavy chain variable complementarity determining regions
1 (CDR1) sequence:
(DNA)

(SEQ ID NO: 1232)

GACGCCTGGATGGAC (amino acids)

(SEQ ID NO: 1233)

DAWMD

-continued

Mouse antibody 29H1 heavy chain variable framework 2 (FW2) sequence:
(DNA)
                                                                (SEQ ID NO: 1234)
TGGGTCCGCCAGTCTCCAGAGAAGGGGCTTGAATGGGTTGCT (amino acids)
                                                                (SEQ ID NO: 1235)
WVRQSPEKGLEWVA Mouse antibody 29H1 heavy chain variable complementarity determining regions
2 (CDR2) sequence:
(DNA)
                                                                (SEQ ID NO: 1236)
GAAATTAGAAGCAAAGCTACTAATCATGCAACATACTATGCTGAGTCTGTGAAAGGG (amino acids)
                                                                (SEQ ID NO: 1237)
EIRSKATNHATYYAESVKG Mouse antibody 29H1 heavy chain variable framework 3 (FW3) sequence:
(DNA)
                                                                (SEQ ID NO: 1238)
AGGTTCACCATCTCAAGAGATGATTCCAAAAGTAGTGTCTACCTGCAAATGAACAGCTTAAGAGCTGAAGACACTGG

CATTTATTACTGTACCCCC (amino acids)
                                                                (SEQ ID NO: 1239)
RFTISRDDSKSSVYLQMNSLRAEDTGIYYCTP Mouse antibody 29H1 heavy chain variable complementarity determining regions
3 (CDR3) sequence:
(DNA)
                                                                (SEQ ID NO: 1240)
CTACTTTACGGGTTTGCTTAC (amino acids)
                                                                (SEQ ID NO: 1241)
LLYGFAY Mouse antibody 29H1 heavy chain variable framework 4 (FW4) sequence:
(DNA)
                                                                (SEQ ID NO: 1242)
TGGGGCCAAGGGACTCTGGTCACTGTCTCTGCA (amino acids)
                                                                (SEQ ID NO: 1243)
WGQGTLVTVSA Mouse antibody 29H1 Light chain: DNA sequence (393 bp)
Signal sequence-FR1-CDR1-FR2-CDR2-FR3-CDR3-FR4
                                                                (SEQ ID NO: 1244)
ATGAAGTTGCCTGTTAGGCTGTTGGTGCTGATGTTCTGGATTCCTGCTTCCAGCAGTGATGTTGTGATGACCCAAAC

TCCACTCTCCCTGCCTGTCAGTCTTGGAGATCAAGCCTCCATCTCTTGCAGATCTGGTCAGAGCCTTGTACACAGTA

ATGGACACACCTATTTACATTGGTACCTGCAGAAGCCAGGCCAGTCTCCAAGGCTCCTGATCTACAAAGTTTCCAAC

CGATTTTCTGGGGTCCCAGACAGGTTCAGTGGCAGTGGATCAAGGGCAGATTTCACACTCAAGATCAGCAGAGTGGA

GGCTGAGGATCTGGGAGTTTATTTCTGCTCTCAAACTACACATGTTCCGTGGACGTTCGGTGGAGGCACCAAGCTGG

AAATCAAA

Mouse antibody 29H1 Light chain: Amino acid sequence (131 aa)
Signal peptide-FR1-CDR1-FR2-CDR2-FR3-CDR3-FR4
                                                                (SEQ ID NO: 1245)
MKLPVRLLVLMFWIPASSSDVVMTQTPLSLPVSLGDQASISCRSGQSLVHSNGHTYLHWYLQKPGQSPRLLIYKVSN

RFSGVPDRFSGSGSRADFTLKISRVEAEDLGVYFCSQTTHVPWTFGGGTKLEIK

Mouse antibody 29H1 light chain variable framework 1 (FW1) sequence:
(DNA)
                                                                (SEQ ID NO: 1246)
GATGTTGTGATGACCCAAACTCCACTCTCCCTGCCTGTCAGTCTTGGAGATCAAGCCTCCATCTCTTGC (amino acids)
                                                                (SEQ ID NO: 1247)
DVVMTQTPLSLPVSLGDQASISC Mouse antibody 29H1 light chain variable complementarity determining regions
1 (CDR1) sequence:
(DNA)
                                                                    (SEQ ID NO: 1248)
AGATCTGGTCAGAGCCTTGTACACAGTAATGGACACACCTATTTACAT (amino acids)
                                                                    (SEQ ID NO: 1249)
RSGQSLVHSNGHTYLH Mouse antibody 29H1 light chain variable framework 2 (FW2) sequence:
(DNA)
                                                                    (SEQ ID NO: 1250)
TGGTACCTGCAGAAGCCAGGCCAGTCTCCAAGGCTCCTGATCTAC (amino acids)
                                                                    (SEQ ID NO: 1251)
WYLQKPGQSPRLLIY Mouse antibody 29H1 light chain variable complementarity determining regions
2 (CDR2) sequence:
(DNA)
                                                                    (SEQ ID NO: 1252)
AAAGTTTCCAACCGATTTTCT (amino acids)
                                                                    (SEQ ID NO: 1253)
KVSNRFS Mouse antibody 29H1 light chain variable framework 3 (FW3) sequence:
(DNA)
                                                                    (SEQ ID NO: 1254)
GGGGTCCCAGACAGGTTCAGTGGCAGTGGATCAAGGGCAGATTTCACACTCAAGATCAGCAGAGTGGAGGCTGAGGA

TCTGGGAGTTTATTTCTGC (amino acids)
                                                                    (SEQ ID NO: 1255)
GVPDRFSGSGSRADFTLKISRVEAEDLGVYFC Mouse antibody 29H1 light chain variable complementarity determining regions
3 (CDR3) sequence:
(DNA)
                                                                    (SEQ ID NO: 1256)
TCTCAAACTACACATGTTCCGTGGACG (amino acids)
                                                                    (SEQ ID NO: 1257)
SQTTHVPWT Mouse antibody 29H1 light chain variable framework 4 (FW4) sequence:
(DNA)
                                                                    (SEQ ID NO: 1258)
TTCGGTGGAGGCACCAAGCTGGAAATCAAA (amino acids)
                                                                    (SEQ ID NO: 1259)
FGGGTKLEIK Mouse antibody 31A1 Heavy chain: DNA sequence (399 bp)
Signal sequence-FR1-CDR1-FR2-CDR2-FR3-CDR3-FR4
                                                                    (SEQ ID NO: 1260)
ATGGAAAGGCACTGGATCTTTCTCTTCCTGTTTTCAGTAACTGCAGGTGTCCACTCCCAGGTCCAGCTTCAGCAGTC

TGGGGCTGAACTGGCAAAACCTGGGGCCTCAGTGAAGATGTCCTGCAAGGCTTCTGGCTACACCTTTACTAGCTACT

GGATGCACTGGGTAAAACAGAGGCCTGGACAGGGTCTGGAATGGATTGGATACATTAATCCTAGCACTGGTTATACT

GAGTACAATCAGAAGTTCAAGGACAAGGCCACATTGACTGCAGACAAATCCTCCAGCACAGCCTACATGCAACTGAG

CAGCCTGACATCTGAGGACTCTGCAGTCTATTACTGTGCAAGAGCCTACATTGACTACTGGGGCCAAGGCACCACTC

TCACAGTCTCCTCA

Mouse antibody 31A1 Heavy chain: Amino acid sequence (133 aa)
Signal peptide-FR1-CDR1-FR2-CDR2-FR3-CDR3-FR4
                                                                    (SEQ ID NO: 1261)
MERHWIFLFLFSVTAGVHSQVQLQQSGAELAKPGASVKMSCKASGYTFTSYWMHWVKQRPGQGLEWIGYINPSTGYT

EYNQKFKDKATLTADKSSSTAYMQLSSLTSEDSAVYYCARAYIDYWGQGTTLTVSS

-continued

Mouse antibody 31A1 heavy chain variable framework 1 (FW1) sequence:
(DNA)
```
                                                              (SEQ ID NO: 1262)
CAGGTCCAGCTTCAGCAGTCTGGGGCTGAACTGGCAAAACCTGGGGCCTCAGTGAAGATGTCCTGCAAGGCTTCTGG

CTACACCTTTACT
```

(amino acids)
```
                                                              (SEQ ID NO: 1263)
QVQLQQSGAELAKPGASVKMSCKASGYTFT
```

Mouse antibody 31A1 heavy chain variable complementarity determining regions
1 (CDR1) sequence:
(DNA)
```
                                                              (SEQ ID NO: 1264)
AGCTACTGGATGCAC
```

(amino acids)
```
                                                              (SEQ ID NO: 1265)
SYWMH
```

Mouse antibody 31A1 heavy chain variable framework 2 (FW2) sequence:
(DNA)
```
                                                              (SEQ ID NO: 1266)
TGGGTAAAACAGAGGCCTGGACAGGGTCTGGAATGGATTGGA
```

(amino acids)
```
                                                              (SEQ ID NO: 1267)
WVKQRPGQGLEWIG
```

Mouse antibody 31A1 heavy chain variable complementarity determining regions
2 (CDR2) sequence:
(DNA)
```
                                                              (SEQ ID NO: 1268)
TACATTAATCCTAGCACTGGTTATACTGAGTACAATCAGAAGTTCAAGGAC
```

(amino acids)
```
                                                              (SEQ ID NO: 1269)
YINPSTGYTEYNQKFKD
```

Mouse antibody 31A1 heavy chain variable framework 3 (FW3) sequence:
(DNA)
```
                                                              (SEQ ID NO: 1270)
AAGGCCACATTGACTGCAGACAAATCCTCCAGCACAGCCTACATGCAACTGAGCAGCCTGACATCTGAGGACTCTGC

AGTCTATTACTGTGCAAGA
```

(amino acids)
```
                                                              (SEQ ID NO: 1271)
KATLTADKSSSTAYMQLSSLTSEDSAVYYCAR
```

Mouse antibody 31A1 heavy chain variable complementarity determining regions
3 (CDR3) sequence:
(DNA)
```
                                                              (SEQ ID NO: 1272)
GCCTACATTGACTAC
```

(amino acids)
```
                                                              (SEQ ID NO: 1273)
AYIDY
```

Mouse antibody 31A1 heavy chain variable framework 4 (FW4) sequence:
(DNA)
```
                                                              (SEQ ID NO: 1274)
TGGGGCCAAGGCACCACTCTCACAGTCTCCTCA
```

(amino acids)
```
                                                              (SEQ ID NO: 1275)
WGQGTTLTVSS
```

Mouse antibody 31A1 Light chain: DNA sequence (393 bp)
Signal sequence-FR1-CDR1-FR2-CDR2-FR3-CDR3-FR4
```
                                                              (SEQ ID NO: 1276)
ATGAAGTTGCCTGTTAGGCTGTTGGTGCTGATGTTCTGGATTCCTGCTTCCAGCAGTGATGTTTTGATGACCCAAAC

TCCACTCTCCCTGCCTGTCAGTCTTGGAGATCAAGCCTCCTTCTCTTGCAGATCTAGTCAGAGCATTGTACATAGTA

ATGGAAACACCTATTTAGAATGGTACCTGCAGAAACCAGGCCAGTCTCCAAAGCTCCTGATCTACAAAGTTTCCAAC

CGATTTTCTGGGGTCCCAGACAGGTTCAGTGGCAGTGGATCAGGGACAGATTTCACACTCAAGATCAACAGAGTGGA
```

-continued

GGCTGAGGATCTGGGAGTTTATTACTGCTTTCAAGTTTCACATTTTCCGTGGACGTTCGGTGGAGGCACCAAGCTGG

AAATCAAA

Mouse antibody 31A1 Light chain: Amino acid sequence (131 aa)
Signal peptide-FR1-CDR1-FR2-CDR2-FR3-CDR3-FR4
                                                            (SEQ ID NO: 1277)
MKLPVRLLVLMFWIPASSSDVLMTQTPLSLPVSLGDQASFSCRSSQSIVHSNGNTYLEWYLQKPGQSPKLLIYKVSN

RFSGVPDRFSGSGSGTDFTLKINRVEAEDLGVYYCFQVSHFPWTFGGGTKLEIK

Mouse antibody 31A1 light chain variable framework 1 (FW1) sequence:
(DNA)
                                                            (SEQ ID NO: 1278)
GATGTTTTGATGACCCAAACTCCACTCTCCCTGCCTGTCAGTCTTGGAGATCAAGCCTCCTTCTCTTGC (amino acids)
                                                            (SEQ ID NO: 1279)
DVLMTQTPLSLPVSLGDQASFSC Mouse antibody 31A1 light chain variable complementarity determining regions
1 (CDR1) sequence:
(DNA)
                                                            (SEQ ID NO: 1280)
AGATCTAGTCAGAGCATTGTACATAGAAATGGAAACACCTATTTAGAA (amino acids)
                                                            (SEQ ID NO: 1281)
                                                            RSSQSIVHRNGNTYLE Mouse antibody 31A1 light chain variable framework 2 (FW2) sequence:
                                                            (DNA)
                                                            (SEQ ID NO: 1282)
TGGTACCTGCAGAAACCAGGCCAGTCTCCAAAGCTCCTGATCTAC (amino acids)
                                                            (SEQ ID NO: 1283)
WYLQKPGQSPKLLIY Mouse antibody 31A1 light chain variable complementarity determining regions
2 (CDR2) sequence:
(DNA)
                                                            (SEQ ID NO: 1284)
AAAGTTTCCAACCGATTTTCT (amino acids)
                                                            (SEQ ID NO: 1285)
KVSNRFS Mouse antibody 31A1 light chain variable framework 3 (FW3) sequence:
(DNA)
                                                            (SEQ ID NO: 1286)
GGGGTCCCAGACAGGTTCAGTGGCAGTGGATCAGGGACAGATTTCACACTCAAGATCAACAGAGTGGAGGCTGAGGA

TCTGGGAGTTTATTACTGC (amino acids)
                                                            (SEQ ID NO: 1287)
GVPDRFSGSGSGTDFTLKINRVEAEDLGVYYC Mouse antibody 31A1 light chain variable complementarity determining regions
3 (CDR3) sequence:
(DNA)
                                                            (SEQ ID NO: 1288)
TTTCAAGTTTCACATTTTCCGTGGACG (amino acids)
                                                            (SEQ ID NO: 1289)
FQVSHFPWT Mouse antibody 31A1 light chain variable framework 4 (FW4) sequence:
(DNA)
                                                            (SEQ ID NO: 1290)
TTCGGTGGAGGCACCAAGCTGGAAATCAAA (amino acids)
                                                            (SEQ ID NO: 1291)
FGGGTKLEIK -continued Mouse antibody 32C1 Heavy chain: DNA sequence (411 bp)
Signal sequence-FR1-CDR1-FR2-CDR2-FR3-CDR3-FR4

(SEQ ID NO: 1292)
ATGTACTTGGGACTGAACTGTGTATTCATAGTTTTTCTCTTAAAAGGTGTCCAGAGTGAAGTGAAGCTTGAGGAGTC

TGGAGGAGGCTTGGTGCAATCTGGAGGATCCATGAAACTCTCCTGTGTTGCCTCTGGATTCACTTTCAGTAATTACT

GGATGAACTGGGTCCGCCAGTCTCCAGAGAAGGGGCTTGAGTGGGTTGCTGAAATTAGATTGAAATCTAATAATTAT

GCAATACATTATGCGGAGTCTGTGAAGGGGAGGTTCACCATCTCAAGAGATGATTCCAAAAGTAGTGTCTACCTGCA

AATGAACAACTTAAGAGCTGAAGACACTGGCATTTATTACTGTACCAGGGTCCCGGGACTGGATGCTTACTGGGGCC

AAGGGACTCTGGTCACTGTCTCTGCA

Mouse antibody 32C1 Heavy chain: Amino acid sequence (137 aa)
Signal peptide-FR1-CDR1-FR2-CDR2-FR3-CDR3-FR4

(SEQ ID NO: 1293)
MYLGLNCVFIVELLKGVQSEVKLEESGGGLVQSGGSMKLSCVASGFTFSNYWMNWVRQSPEKGLEWVAEIRLKSNNY

AIHYAESVKGRFTISRDDSKSSVYLQMNNLRAEDTGIYYCTRVPGLDAYWGQGTLVTVSA

Mouse antibody 32C1 heavy chain variable framework 1 (FW1) sequence:
(DNA)

(SEQ ID NO: 1294)
GAAGTGAAGCTTGAGGAGTCTGGAGGAGGCTTGGTGCAATCTGGAGGATCCATGAAACTCTCCTGTGTTGCCTCTGG

ATTCACTTTCAGT (amino acids)

(SEQ ID NO: 1295)
EVKLEESGGGLVQSGGSMKLSCVASGFTFS

Mouse antibody 32C1 heavy chain variable complementarity determining regions
1 (CDR1) sequence:
(DNA)

(SEQ ID NO: 1296)
AATTACTGGATGAAC (amino acids)

(SEQ ID NO: 1297)
NYWMN

Mouse antibody 32C1 heavy chain variable framework 2 (FW2) sequence:
(DNA)

(SEQ ID NO: 1298)
TGGGTCCGCCAGTCTCCAGAGAAGGGGCTTGAGTGGGTTGCT (amino acids)

(SEQ ID NO: 1299)
WVRQSPEKGLEWVA

Mouse antibody 32C1 heavy chain variable complementarity determining regions
2 (CDR2) sequence:
(DNA)

(SEQ ID NO: 1300)
GAAATTAGATTGAAATCTAATAATTATGCAATACATTATGCGGAGTCTGTGAAGGGG (amino acids)

(SEQ ID NO: 1301)
EIRLKSNNYAIHYAESVKG

Mouse antibody 32C1 heavy chain variable framework 3 (FW3) sequence:
(DNA)

(SEQ ID NO: 1302)
AGGTTCACCATCTCAAGAGATGATTCCAAAAGTAGTGTCTACCTGCAAATGAACAACTTAAGAGCTGAAGACACTGG

CATTTATTACTGTACCAGG (amino acids)

(SEQ ID NO: 1303)
RFTISRDDSKSSVYLQMNNLRAEDTGIYYCTR

Mouse antibody 32C1 heavy chain variable complementarity determining regions
3 (CDR3) sequence:
(DNA)

(SEQ ID NO: 1304)
GTCCCGGGACTGGATGCTTAC (amino acids)

(SEQ ID NO: 1305)

VPGLDAY

Mouse antibody 32C1 heavy chain variable framework 4 (FW4) sequence:
(DNA)

(SEQ ID NO: 1306)

TGGGGCCAAGGGACTCTGGTCACTGTCTCTGCA (amino acids)

(SEQ ID NO: 1307)

WGQGTLVTVSA

Mouse antibody 32C1 Light chain: DNA sequence (393 bp)
Signal sequence-FR1-CDR1-FR2-CDR2-FR3-CDR3-FR4

(SEQ ID NO: 1308)

ATGAAGTTGCCTGTTAGGCTGTTGGTGCTGATGTTCTGGATTCCTGCTTCCAGCAGTGATGTTGTGATGACCCAAAC

TCCACTCTCCCTGCCTGTCAGTCTTGGAGATCAAGCCTCCATCTCTTGCAGATCTAGTCAGAGCCTTGTACACAGTA

ATGGAAACACCTATTTACATTGGTACCTGCAGAAGCCAGGCCAGTCTCCAAAGCTCCTGATCTACAAAGTTTCCAAC

CGATTTTCTGGGGTCCCAGACAGGTTCAGTGGCAGTGGATCAGGGACAGATTTCACACTCAAGATCAGCAGTGTGGA

GGCTGAGGATCTGGGAGTTTATTTCTGCTCTCAAATTACACATGTTCCGTACACGTTCGGAGGGGGGACCAATCTGG

AAATAAAA

Mouse antibody 32C1 Light chain: Amino acid sequence (131 aa)
Signal peptide-FR1-CDR1-FR2-CDR2-FR3-CDR3-FR4

(SEQ ID NO: 1309)

MKLPVRLLVLMFWIPASSSDVVMTQTPLSLPVSLGDQASISCRSSQSLVHSNGNTYLHWYLQKPGQSPKLLIYKVSN

RFSGVPDRFSGSGSGTDFTLKISSVEAEDLGVYFCSQITHVPYTFGGGTNLEIK

Mouse antibody 32C1 light chain variable framework 1 (FW1) sequence:
(DNA)

(SEQ ID NO: 1310)

GATGTTGTGATGACCCAAACTCCACTCTCCCTGCCTGTCAGTCTTGGAGATCAAGCCTCCATCTCTTGC (amino acids)

(SEQ ID NO: 1311)

DVVMTQTPLSLPVSLGDQASISC

Mouse antibody 32C1 light chain variable complementarity determining regions
1 (CDR1) sequence:
(DNA)

(SEQ ID NO: 1312)

AGATCTAGTCAGAGCCTTGTACACAGTAATGGAAACACCTATTTACAT (amino acids)

(SEQ ID NO: 1313)

RSSQSLVHSNGNTYLH

Mouse antibody 32C1 light chain variable framework 2 (FW2) sequence:
(DNA)

(SEQ ID NO: 1314)

TGGTACCTGCAGAAGCCAGGCCAGTCTCCAAAGCTCCTGATCTAC (amino acids)

(SEQ ID NO: 1315)

WYLQKPGQSPKLLIY

Mouse antibody 32C1 light chain variable complementarity determining regions
2 (CDR2) sequence:
(DNA)

(SEQ ID NO: 1316)

AAAGTTTCCAACCGATTTTCT (amino acids)

(SEQ ID NO: 1317)

KVSNRFS

Mouse antibody 32C1 light chain variable framework 3 (FW3) sequence:
(DNA)

(SEQ ID NO: 1318)

GGGGTCCCAGACAGGTTCAGTGGCAGTGGATCAGGGACAGATTTCACACTCAAGATCAGCAGTGTGGAGGCTGAGGA

TCTGGGAGTTTATTTCTGC

-continued (amino acids)
                                                                    (SEQ ID NO: 1319)
GVPDRFSGSGSGTDFTLKISSVEAEDLGVYFC Mouse antibody 32C1 light chain variable complementarity determining regions
3 (CDR3) sequence:
(DNA)
                                                                    (SEQ ID NO: 1320)
TCTCAAATTACACATGTTCCGTACACG (amino acids)
                                                                    (SEQ ID NO: 1321)
SQITHVPYT Mouse antibody 32C1 light chain variable framework 4 (FW4) sequence:
(DNA)
                                                                    (SEQ ID NO: 1322)
TTCGGAGGGGGGACCAATCTGGAAATAAAA (amino acids)
                                                                    (SEQ ID NO: 1323)
FGGGTNLEIK Mouse antibody 45C11 Heavy chain: DNA sequence (423 bp)
Signal sequence-FR1-CDR1-FR2-CDR2-FR3-CDR3-FR4
                                                                    (SEQ ID NO: 1324)
ATGAAATGCAGCTGGGTTATCTTCTTCCTGATGGCAGTGGTTACAGGGGTCAATTCAGAGGTTCAGCTGCAGCAGTC

TGGGGCAGACCTTGTGAAGCCAGGGGCCTCAGTCAAGTTGTCCTGCACAGCTTCTGGCTTCAACATTAAAGACACCT

TTATGCACTGGGTGAAGCAGAGGCCTGAACAGGGCCTGGAGTGGATTGGAAGGATTGATCCTGCGAATGGTAATACT

AAATATGACCCGAAATTCCAGGGCAAGGCCACTATAACAGCAGACACATCCTCCAACACAGCCTACCTGCAGCTCAG

CAGCCTGACATCTGAGGACACTGCCGTCTATTACTGTGCTAAACCGTATGGTAACTACGGCTATTACTATGCTTTGG

ACTACTGGGGTCAAGGAACCTCAGTCACCGTCTCCTCA

Mouse antibody 45C11 Heavy chain: Amino acid sequence (141 aa)
Signal peptide-FR1-CDR1-FR2-CDR2-FR3-CDR3-FR4
                                                                    (SEQ ID NO: 1325)
MKCSWVIFFLMAVVTGVNSEVQLQQSGADLVKPGASVKLSCTASGENIKDTFMHWVKQRPEQGLEWIGRIDPANGNT

KYDPKFQGKATITADTSSNTAYLQLSSLTSEDTAVYYCAKPYGNYGYYYALDYWGQGTSVTVSS

Mouse antibody 45C11 heavy chain variable framework 1 (FW1) sequence:
(DNA)
                                                                    (SEQ ID NO: 1326)
GAGGTTCAGCTGCAGCAGTCTGGGGCAGACCTTGTGAAGCCAGGGGCCTCAGTCAAGTTGTCCTGCACAGCTTCTGG

CTTCAACATTAAA (amino acids)
                                                                    (SEQ ID NO: 1327)
EVQLQQSGADLVKPGASVKLSCTASGFNIK Mouse antibody 45C11 heavy chain variable complementarity determining regions
1 (CDR1) sequence:
(DNA)
                                                                    (SEQ ID NO: 1328)
GACACCTTTATGCAC (amino acids)
                                                                    (SEQ ID NO: 1329)
DTFMH Mouse antibody 45C11 heavy chain variable framework 2 (FW2) sequence:
(DNA)
                                                                    (SEQ ID NO: 1330)
TGGGTGAAGCAGAGGCCTGAACAGGGCCTGGAGTGGATTGGA (amino acids)
                                                                    (SEQ ID NO: 1331)
WVKQRPEQGLEWIG Mouse antibody 45C11 heavy chain variable complementarity determining regions
2 (CDR2) sequence:
(DNA)
                                                                    (SEQ ID NO: 1332)
AGGATTGATCCTGCGAATGGTAATACTAAATATGACCCGAAATTCCAGGGC -continued (amino acids)
                                                                                    (SEQ ID NO: 1333)
RIDPANGNTKYDPKFQG Mouse antibody 45C11 heavy chain variable framework 3 (FW3) sequence:
(DNA)
                                                                                    (SEQ ID NO: 1334)
AAGGCCACTATAACAGCAGACACATCCTCCAACACAGCCTACCTGCAGCTCAGCAGCCTGACATCTGAGGACACTGC

CGTCTATTACTGTGCTAAA (amino acids)
                                                                                    (SEQ ID NO: 1335)
KATITADTSSNTAYLQLSSLTSEDTAVYYCAK Mouse antibody 45C11 heavy chain variable complementarity determining regions
3 (CDR3) sequence:
(DNA)
                                                                                    (SEQ ID NO: 1336)
CCGTATGGTAACTACGGCTATTACTATGCTTTGGACTAC (amino acids)
                                                                                    (SEQ ID NO: 1337)
PYGNYGYYYALDY Mouse antibody 45C11 heavy chain variable framework 4 (FW4) sequence:
(DNA)
                                                                                    (SEQ ID NO: 1338)
TGGGGTCAAGGAACCTCAGTCACCGTCTCCTCA (amino acids)
                                                                                    (SEQ ID NO: 1339)
WGQGTSVTVSS Mouse antibody 45C11 Light chain: DNA sequence (381 bp)
Signal sequence-FR1-CDR1-FR2-CDR2-FR3-CDR3-FR4
                                                                                    (SEQ ID NO: 1340)
ATGAGGTTCCAGGTTCAGGTTCTGGGGCTCCTTCTGCTCTGGATATCAGGTGCCCAGTGTGATGTCCAGATAACCCA

GTCTCCATCTTATCTTGCTGCATCTCCTGGAGAAACCATTACTATTAATTGCAGGGCAAGTAAGAGCATTAGCAAAT

ATTTAGCCTGGTATCAAGAGAAACCTGGGAAAACTAATAAGCTTCTTATCTACTCTGGATCCACTTTGCAATCTGGA

ATTCCATCAAGGTTCAGTGGCAGTGGATCTGGTACAGATTTCACTCTCACCATCAGTAGCCTGGAGCCTGAAGATTT

TGCAATGTATTACTGTCAACAGCATAATGAATTCCCGTGGACGTTCGGTGGAGGCACCAAGCTGGAAATCAAA

Mouse antibody 45C11 Light chain: Amino acid sequence (127 aa)
Signal peptide-FR1-CDR1-FR2-CDR2-FR3-CDR3-FR4
                                                                                    (SEQ ID NO: 1341)
MRFQVQVLGLLLLWISGAQCDVQITQSPSYLAASPGETITINCRASKSISKYLAWYQEKPGKTNKLLIYSGSTLQSG

IPSRFSGSGSGTDFTLTISSLEPEDFAMYYCQQHNEFPWTEGGGTKLEIK

Mouse antibody 45C11 light chain variable framework 1 (FW1) sequence:
(DNA)
                                                                                    (SEQ ID NO: 1342)
GATGTCCAGATAACCCAGTCTCCATCTTATCTTGCTGCATCTCCTGGAGAAACCATTACTATTAATTGC (amino acids)
                                                                                    (SEQ ID NO: 1343)
DVQITQSPSYLAASPGETITINC Mouse antibody 45C11 light chain variable complementarity determining regions
1 (CDR1) sequence:
(DNA)
                                                                                    (SEQ ID NO: 1344)
AGGGCAAGTAAGAGCATTAGCAAATATTTAGCC (amino acids)
                                                                                    (SEQ ID NO: 1345)
RASKSISKYLA Mouse antibody 45C11 light chain variable framework 2 (FW2) sequence:
(DNA)
                                                                                    (SEQ ID NO: 1346)
TGGTATCAAGAGAAACCTGGGAAAACTAATAAGCTTCTTATCTAC (amino acids)
                                                                                    (SEQ ID NO: 1347)
WYQEKPGKTNKLLIY -continued Mouse antibody 45C11 light chain variable complementarity determining regions
2 (CDR2) sequence:
(DNA)

(SEQ ID NO: 1348)
TCTGGATCCACTTTGCAATCT (amino acids)

(SEQ ID NO: 1349)
SGSTLQS

Mouse antibody 45C11 light chain variable framework 3 (FW3) sequence:
(DNA)

(SEQ ID NO: 1350)
GGAATTCCATCAAGGTTCAGTGGCAGTGGATCTGGTACAGATTTCACTCTCACCATCAGTAGCCTGGAGCCTGAAGA

TTTTGCAATGTATTACTGT (amino acids)

(SEQ ID NO: 1351)
GIPSRFSGSGSGTDFTLTISSLEPEDFAMYYC

Mouse antibody 45C11 light chain variable complementarity determining regions
3 (CDR3) sequence:
(DNA)

(SEQ ID NO: 1352)
CAACAGCATAATGAATTCCCGTGGACG (amino acids)

(SEQ ID NO: 1353)
QQHNEFPWT

Mouse antibody 45C11 light chain variable framework 4 (FW4) sequence:
(DNA)

(SEQ ID NO: 1354)
TTCGGTGGAGGCACCAAGCTGGAAATCAAA (amino acids)

(SEQ ID NO: 1355)
FGGGTKLEIK
5C6F3

Mouse 5C6F3 heavy chain variable framework 1 (FW1) sequence:
(DNA)

(SEQ ID NO: 1356)
Gaagtgatgctggtggagtctggggggaggcttagtgaagcctggagggtccctgaaactctcctgtgcagcctctgg attcactttcagt (amino acids)

(SEQ ID NO: 1357)
EVMLVESGGGLVKPGGSLKLSCAASGFTES

Mouse 5C6F3 heavy chain variable complementarity determining regions 1 (CDR1)
sequence:
(DNA)

(SEQ ID NO: 1358)
acctatgccatgtct (amino acids)

(SEQ ID NO: 1359)
TYAMS

Mouse 5C6F3 heavy chain variable framework 2 (FW2) sequence:
(DNA)

(SEQ ID NO: 1360)
tgggttcgccagactccggagaagaggctggagtgggtcgca (amino acids)

(SEQ ID NO: 1361)
WVRQTPEKRLEWVA

Mouse 5C6F3 heavy chain variable complementarity determining regions 2 (CDR2)
sequence:
(DNA)

(SEQ ID NO: 1362)
gccattagtaatggtggtggttacacctactatccagacagtctgaaggggg (amino acids)

(SEQ ID NO: 1363)
AISNGGGYTYYPDSLKG

-continued

Mouse 5C6F3 heavy chain variable framework 3 (FW3) sequence:
(DNA)
                                                              (SEQ ID NO: 1364)
cgattcaccatctccagagacaatgccaagaacaccctgtacctgcaaatgagcagtctgaggtctgaggacacggc cacgtattactgtgcaaga (amino acids)
                                                              (SEQ ID NO: 1365)
RFTISRDNAKNTLYLQMSSLRSEDTATYYCAR Mouse 5C6F3 heavy chain variable complementarity determining regions 3 (CDR3)
sequence:
(DNA)
                                                              (SEQ ID NO: 1366)
cgttactatgatcactactttgactac (amino acids)
                                                              (SEQ ID NO: 1367)
RYYDHYFDY Mouse 5C6F3 heavy chain variable framework 4 (FW4) sequence:
(DNA)
                                                              (SEQ ID NO: 1368)
tggggccaaggcaccgctctcacggtctcctca (amino acids)
                                                              (SEQ ID NO: 1369)
WGQGTALTVSS Mouse 5C6F3 light chain variable framework 1 (FR1) sequence:
(DNA)
                                                              (SEQ ID NO: 1370)
gatgttttgatgacccaaactccactctccctgcctgtcagtcttggagatcaagcctccatctcttgc (amino acids)
                                                              (SEQ ID NO: 1371)
DVLMTQTPLSLPVSLGDQASISC Mouse 5C6F3 light chain variable complementarity determining regions 1 (CDR1)
sequence:
(DNA)
                                                              (SEQ ID NO: 1372)
agatctagtcagaccattgtacatagtaatggaaacacctatttagaa (amino acids)
                                                              (SEQ ID NO: 1373)
RSSQTIVHSNGNTYLE Mouse 5C6F3 light chain variable framework 2 (FR2) sequence:
(DNA)
                                                              (SEQ ID NO: 1374)
tggtacctgcagaaaccaggccagtctccaaagctcctgatctac (amino acids)
                                                              (SEQ ID NO: 1375)
WYLQKPGQSPKLLIY Mouse 5C6F3 light chain variable complementarity determining regions 2 (CDR2)
sequence:
(DNA)
                                                              (SEQ ID NO: 1376)
aaagtttccaaccgattttct (amino acids)
                                                              (SEQ ID NO: 1377)
KVSNRFS Mouse 5C6F3 light chain variable framework 3 (FR3) sequence:
(DNA)
                                                              (SEQ ID NO: 1378)
ggggtcccagacaggttcagtggcagtggatcagggacagatttcacactcaagatcagcagggtggaggctgagga tctgggagtttattactgc (amino acids)
                                                              (SEQ ID NO: 1379)
GVPDRFSGSGSGTDFTLKISRVEAEDLGVYYC -continued Mouse 5C6F3 light chain variable complementarity determining regions 3 (CDR3)
sequence:
(DNA)

(SEQ ID NO: 1380)

tttcaagattcacatgttcctctcacg (amino acids)

(SEQ ID NO: 1381)

FQDSHVPLT

Mouse 5C6F3 light chain variable framework 4 (FR4) sequence:
(DNA)

(SEQ ID NO: 1382)

ttcggtgctgggaccaagctggagctgaaa (amino acids)

(SEQ ID NO: 1383)

FGAGTKLELK mu5C6F3 scFv- sequence
(DNA)

(SEQ ID NO: 1384)

gaagtgatgctggtggagtctggggggaggcttagtgaagcctggagggtccctgaaactctcctgtgcagcctctgg attcactttcagtacctatgccatgtcttgggttcgccagactccggagaagaggctggagtgggtcgcagccatta gtaatggtggtggttacacctactatccagacagtctgaaggggcgattcaccatctccagagacaatgccaagaac accctgtacctgcaaatgagcagtctgaggtctgaggacacggccacgtattactgtgcaagacgttactatgatca ctactttgactactggggccaaggcaccgctctcacggtctcctcaggtggcggaggatctggcggaggtggaagcg gcggaggcggatccgatgtttgatgacccaaactccactctccctgcctgtcagtcttggagatcaagcctccatc tcttgcagatctagtcagaccattgtacatagtaatggaaacacctatttagaatggtacctgcagaaaccaggcca gtctccaaagctcctgatctacaaagtttccaaccgattttctggggtcccagacaggttcagtggcagtggatcag ggacagatttcacactcaagatcagcagggtggaggctgaggatctgggagtttattactgctttcaagattcacat gttcctctcacgttcggtgctgggaccaagctggagctgaaa (amino acids)

(SEQ ID NO: 1385)

EVMLVESGGGLVKPGGSLKLSCAASGFTFSTYAMSWVRQTPEKRLEWVAAISNGGGYTYYPDSLKGRFTISRDNAKN

TLYLQMSSLRSEDTATYYCARRYYDHYFDYWGQGTALTVSSGGGGSGGGGSGGGGSDVLMTQTPLSLPVSLGDQASI

SCRSSQTIVHSNGNTYLEWYLQKPGQSPKLLIYKVSNRFSGVPDRFSGSGSGTDFTLKISRVEAEDLGVYYCFQDSH

VPLTFGAGTKLELK

3C2B1
Mouse 3C2B1 heavy chain variable framework 1 (CDR1) sequence:
(DNA)

(SEQ ID NO: 1386)

gaagtgatgctggtggagtctggggggaggcttagtgaagcctggagggtccctgaaactctcctgtgcagcctctgg aatcactttcagt (amino acids)

(SEQ ID NO: 1387)

EVMLVESGGGLVKPGGSLKLSCAASGITFS

Mouse 3C2B1 heavy chain variable complementarity determining regions 1 (CDR1)
sequence:
(DNA)

(SEQ ID NO: 1388)

acctataccatgtcg (amino acids)

(SEQ ID NO: 1389)

TYTMS

Mouse 3C2B1 heavy chain variable framework 2 (CDR2) sequence:
(DNA)

(SEQ ID NO: 1390)

tgggttcgccagactccggagaagaggctggagtgggtcgca

-continued (amino acids)
                                                                (SEQ ID NO: 1391)
WVRQTPEKRLEWVA Mouse 3C2B1 heavy chain variable complementarity determining regions 2 (CDR2)
sequence:
(DNA)
                                                                (SEQ ID NO: 1392)
accattagtactggtggtgataaaacctactattcagacagtgtgaagggt (amino acids)
                                                                (SEQ ID NO: 1393)
TISTGGDKTYYSDSVKG Mouse 3C2B1 heavy chain variable framework 3 (CDR3) sequence:
(DNA)
                                                                (SEQ ID NO: 1394)
cgattcaccatctccagagacaatgccaagaacaacctgtacctccaaatgagcagtctgaggtctgaggacacggc cttgtattactgtgcaagg (amino acids)
                                                                (SEQ ID NO: 1395)
RFTISRDNAKNNLYLQMSSLRSEDTALYYCAR Mouse 3C2B1 heavy chain variable complementarity determining regions 3 (CDR3)
sequence:
(DNA)
                                                                (SEQ ID NO: 1396)
ggaaccacggctatgtattactatgctatggactac (amino acids)
                                                                (SEQ ID NO: 1397)
GTTAMYYYAMDY Mouse 3C2B1 heavy chain variable framework 4 (CDR4) sequence:
(DNA)
                                                                (SEQ ID NO: 1398)
tggggtcaaggaacctcagtcaccgtctcctca (amino acids)
                                                                (SEQ ID NO: 1399)
WGQGTSVTVSS Mouse 3C2B1 light chain variable framework 1 (FW1) sequence:
(DNA)
                                                                (SEQ ID NO: 1400)
gacattgtgctgacacagtctcctgcttccttagctgtatctctggggcagagggccaccatctcatgc (amino acids)
                                                                (SEQ ID NO: 1401)
DIVLTQSPASLAVSLGQRATISC Mouse 3C2B1 light chain variable complementarity determining regions 1 (CDR1)
sequence:
(DNA)
                                                                (SEQ ID NO: 1402)
agggccagcaaaagtatcagtacatctgactataattatattcac (amino acids)
                                                                (SEQ ID NO: 1403)
RASKSISTSDYNYIH Mouse 3C2B1 light chain variable framework 2 (FW2) sequence:
(DNA)
                                                                (SEQ ID NO: 1404)
tggtaccaacagaaaccaggacagccacccaaactcctcatctat (amino acids)
                                                                (SEQ ID NO: 1405)
WYQQKPGQPPKLLIY Mouse 3C2B1 light chain variable complementarity determining regions 2 (CDR2)
sequence:
(DNA)
                                                                (SEQ ID NO: 1406)
CTTGCATCCAACCTAGAATCT -continued (amino acids)
(SEQ ID NO: 1407)
LASNLES Mouse 3C2B1 light chain variable framework 3 (FW3) sequence:
(DNA)
(SEQ ID NO: 1408)
gggtccctgccaggttcagtggcagtgggtctgggacagacttcaccctcaacatccatcctgtggaggaagaagat gctgcaacctattactgt (amino acids)
(SEQ ID NO: 1409)
GVPARFSGSGSGTDFTLNIHPVEEEDAATYYC Mouse 3C2B1 light chain variable complementarity determining regions 3 (CDR3)
sequence:
(DNA)
(SEQ ID NO: 1410)
cagcacagtagggagcttcctctcacg (amino acids)
(SEQ ID NO: 1411)
QHSRELPLT Mouse 3C2B1 light chain variable framework 4 (FW4) sequence:
(DNA)
(SEQ ID NO: 1412)
ttcggtgctgggaccaagctggagctgaaa (amino acids)
(SEQ ID NO: 1413)
FGAGTKLELK Mouse B12 heavy chain variable framework 1 (FW1) sequence:
(DNA)
(SEQ ID NO: 1414)
Caggcgcagctgaaggagtcaggacctggcctggtggcgccctcacagagcctgtccatcacttgcactgtctctgg gttttcattaacc (amino acids)
(SEQ ID NO: 1415)
QAQLKESGPGLVAPSQSLSITCTVSGFSLT Mouse B12 heavy chain variable complementarity determining regions 1 (CDR1)
sequence:
(DNA)
(SEQ ID NO: 1416)
agctatggtgtacac (amino acids)
(SEQ ID NO: 1417)
SYGVH Mouse B12 heavy chain variable framework 2 (FW2) sequence:
(DNA)
(SEQ ID NO: 1418)
tgggttcgccagcctccaggaaagggtctggagtggctggga (amino acids)
(SEQ ID NO: 1419)
WVRQPPGKGLEWLG Mouse B12 heavy chain variable complementarity determining regions 2 (CDR2)
sequence:
(DNA)
(SEQ ID NO: 1420)
gtaatatggcctggtggaagcacaaattataattcgactctcatgtccagaatg (amino acids)
(SEQ ID NO: 1421)
VIWPGGSTNYNSTLMSRM Mouse B12 heavy chain variable framework 3 (FW3) sequence:
(DNA)
(SEQ ID NO: 1422)
cggatcatcaaagacaactccaagagccaagttttcttaaaaatgaacagtctgcaaattgatgacacagccatgta
ctactgtgccaga -continued (amino acids)

(SEQ ID NO: 1423)

RIIKDNSKSQVFLKMNSLQIDDTAMYYCAR

Mouse B12 heavy chain variable complementarity determining regions 3 (CDR3)
sequence:
(DNA)

(SEQ ID NO: 1424)

gatcggacacctcgggtgggggcctggtttgcttac (amino acids)

(SEQ ID NO: 1425)

DRTPRVGAWFAY

Mouse B12 heavy chain variable framework 4 (FW4) sequence:
(DNA)

(SEQ ID NO: 1426)

tggggccaagggactctggtcactgtctctgcag (amino acids)

(SEQ ID NO: 1427)

WGQGTLVTVSA

Mouse B12 light chain variable framework 1 (FR1) sequence:
(DNA)

(SEQ ID NO: 1428)

atcattgtgctgacccaatctccagcttctttggctgtgtctctagggcagagggccaccatatcctgc (amino acids)

(SEQ ID NO: 1429)

IIVLTQSPASLAVSLGQRATISC

Mouse B12 light chain variable complementarity determining regions 1 (CDR1)
Sequence:
(DNA)

(SEQ ID NO: 1430)

agagccagtgagagtgttgctacttatggcaataattttatgcag (amino acids)

(SEQ ID NO: 1431)

RASESVATYGNNFMQ

Mouse B2 heavy chain variable framework 1 (FW1) sequence:
(DNA)

(SEQ ID NO: 1432)

gaagtggtgctggtggagtctggggggaggcttagtggagcctggagggtccctgaaactctcctgtgtagcctctgg attcgctttcagt (amino acids)

(SEQ ID NO: 1433)

EVVLVESGGGLVEPGGSLKLSCVASGFAFS

Mouse B2 heavy chain variable complementarity determining regions 1 (CDR1)
sequence:
(DNA)

(SEQ ID NO: 1434)

acctttgccatgtct (amino acids)

(SEQ ID NO: 1435)

TEAMS

Mouse B2 heavy chain variable framework 2 (FW2) sequence:
(DNA)

(SEQ ID NO: 1436)

tggattcgccagactccggagaagaggctggagtgggtcgca (amino acids)

(SEQ ID NO: 1437)

WIRQTPEKRLEWVA

Mouse B2 heavy chain variable complementarity determining regions 2 (CDR2)
sequence:
(DNA)

(SEQ ID NO: 1438)

gccattagtaatggtggtggttacacctactatccagacactctgaagggg (amino acids)

(SEQ ID NO: 1439)

AISNGGGYTYYPDTLKG

Mouse B2 heavy chain variable framework 3 (FW3) sequence:
(DNA)

(SEQ ID NO: 1440)

cgattctccatctccagagacaatgccaagaataccctgtacctgcaaatgagtagtctgaggtctgaggacacggc cgtgtattactgtgcaaga (amino acids)

(SEQ ID NO: 1441)

RFSISRDNAKNTLYLQMSSLRSEDTAVYYCAR

Mouse B2 heavy chain variable complementarity determining regions 3 (CDR3)
Sequence:
(DNA)

(SEQ ID NO: 1442)

cgctactatgatctctactttgactta (amino acids)

(SEQ ID NO: 1443)

RYYDLYFDL

Mouse B2 heavy chain variable framework 4 (FW4) sequence:
(DNA)

(SEQ ID NO: 1444)

Tggggccgaggcacctctctcatagtctcctca (amino acids)

(SEQ ID NO: 1445)

WGRGTSLIVSS

Mouse B2 light chain variable framework 1 (FR1) sequence:
(DNA)

(SEQ ID NO: 1446)

gatattctgatgacccaaactccactctccctgcctgtcagtcttggagatcaagcctccatttcttgc (amino acids)

(SEQ ID NO: 1447)

DILMTQTPLSLPVSLGDQASISC
Mouse B2 light chain variable complementarity determining regions 1 (CDR1)

sequence:
(DNA)

(SEQ ID NO: 1448)

agatctagtcagaacattgtacatagtaatggaaacacctatttagaa (amino acids)

(SEQ ID NO: 1449)

RSSQNIVHSNGNTYLE

Mouse B2 light chain variable framework 2 (FR2) sequence:
(DNA)

(SEQ ID NO: 1450)

tggtacctgcagaaaccaggccagtctccaaagctcctgatctac (amino acids)

(SEQ ID NO: 1451)

WYLQKPGQSPKLLIY

Mouse B2 light chain variable complementarity determining regions 2 (CDR2)
sequence:
(DNA)

(SEQ ID NO: 1452)

aaagtttccaaccgattttct (amino acids)

(SEQ ID NO: 1453)

KVSNRFS

Mouse B2 light chain variable framework 3 (FR3) sequence:
(DNA)

(SEQ ID NO: 1454)

ggggtccccgacaggttcagtggtagtgggtcagggacagatttcacactcaagatcagcagagtggaggctgagga tctgggagtttattactgc (amino acids)

(SEQ ID NO: 1455)

GVPDRFSGSGSGTDFTLKISRVEAEDLGVYYC

-continued

Mouse B2 light chain variable complementarity determining regions 3 (CDR3)
sequence:
(DNA)
```
                                                          (SEQ ID NO: 1456)
tttcaagattcacatgttcctctcacg
```

```
(amino acids)
                                                          (SEQ ID NO: 1457)
FQDSHVPLT
```

Mouse B2 light chain variable framework 4 (FR4) sequence:
(DNA)
```
                                                          (SEQ ID NO: 1458)
ttcggtgctgggaccaggctggagctgaaa
```

```
(amino acids)
                                                          (SEQ ID NO: 1459)
FGAGTRLELK
```

Mouse B7 heavy chain variable framework 1 (FW1) sequence:
(DNA)
```
                                                          (SEQ ID NO: 1460)
gaggtgcaggtggtggagtctgggggagacttagtgaagcctggagggtccctgaaactctcctgtgcagcctctgg attcactttcagt
```

```
(amino acids)
                                                          (SEQ ID NO: 1461)
EVQVVESGGDLVKPGGSLKLSCAASGFTFS
```

B7 heavy chain variable complementarity determining regions 1 (CDR1)
sequence:
(DNA)
```
                                                          (SEQ ID NO: 1462)
agatatggcatgtct
```

```
(amino acids)
                                                          (SEQ ID NO: 1463)
RYGMS
```

Mouse B7 heavy chain variable framework 2 (FW2) sequence:
(DNA)
```
                                                          (SEQ ID NO: 1464)
tgggttcgccagactccagacaagaggctggagtgggtcgca
```

```
(amino acids)
                                                          (SEQ ID NO: 1465)
WVRQTPDKRLEWVA
```
Mouse B7 heavy chain variable complementarity determining regions 2 (CDR2)

sequence:
(DNA)
```
                                                          (SEQ ID NO: 1466)
accattagtagtggtggtacttacatctactatccagacagtgtgaagggg
```

```
(amino acids)
                                                          (SEQ ID NO: 1467)
TISSGGTYIYYPDSVKG
```

Mouse B7 heavy chain variable framework 3 (FW3) sequence:
(DNA)
```
                                                          (SEQ ID NO: 1468)
cgattcaccatctccagagacaatgccaagaacaccctgtacctgcaaatgagcagtctgaagtctgaggacacagc catgtattactgtgcaagg
```

```
(amino acids)
                                                          (SEQ ID NO: 1469)
RFTISRDNAKNTLYLQMSSLKSEDTAMYYCAR
```

Mouse B7 heavy chain variable complementarity determining regions 3 (CDR3)
sequence:
(DNA)
```
                                                          (SEQ ID NO: 1470)
gataactacggtagtagctacgactatgctatggactac
```

```
(amino acids)
                                                          (SEQ ID NO: 1471)
DNYGSSYDYAMDY
```

-continued

Mouse B7 heavy chain variable framework 4 (FW4) sequence:
(DNA)

(SEQ ID NO: 1472)

tggggtcaaggaacctcagtcaccgtctcctca (amino acids)

(SEQ ID NO: 1473)

WGQGTSVTVSS

Mouse B7 light chain variable framework 1 (FR1) sequence:
(DNA)

(SEQ ID NO: 1474)

gatgttttgatgacccaaactccactctccctgcctgtcagtcttggagatcaagcctccatctcttgc (amino acids)

(SEQ ID NO: 1475)

DVLMTQTPLSLPVSLGDQASISC

Mouse B7 light chain variable complementarity determining regions 1 (CDR1)
sequence:
(DNA)

(SEQ ID NO: 1476)

agatctagtcagaccattgtacatagtaatggaaacacctatttagaa (amino acids)

(SEQ ID NO: 1477)

RSSQTIVHSNGNTYLE

Mouse B7 light chain variable framework 2 (FR2) sequence:
(DNA)

(SEQ ID NO: 1478)

tggtacctgcaaaaaccaggccagtctccaaagctcctgatctac (amino acids)

(SEQ ID NO: 1479)

WYLQKPGQSPKLLIY

Mouse B7 light chain variable complementarity determining regions 2 (CDR2)
sequence:
(DNA)

(SEQ ID NO: 1480)

aaagtttccaaccgattttct (amino acids)

(SEQ ID NO: 1481)

KVSNRFS

Mouse B7 light chain variable framework 3 (FR3) sequence:
(DNA)

(SEQ ID NO: 1482)

ggggtcccagacaggttcagtggcagtggatcagggacagatttcacactcaagatcagcagggtggaggctgagga tctgggagtttattactgc (amino acids)

(SEQ ID NO: 1483)

GVPDRFSGSGSGTDFTLKISRVEAEDLGVYYC

Mouse B7 light chain variable complementarity determining regions 3 (CDR3)
sequence:
(DNA)

(SEQ ID NO: 1484)

tttcaagattcacatgttcctctcacg (amino acids)

(SEQ ID NO: 1485)

FQDSHVPLT

Mouse B7 light chain variable framework 4 (FR4) sequence:
(DNA)

(SEQ ID NO: 1486)

ttcggtgctgggaccaagctggagctgaaa (amino acids)

(SEQ ID NO: 1487)

FGAGTKLELK

-continued

Mouse 8C7F3 heavy chain variable framework 1 (FW1) sequence:
(DNA)
(SEQ ID NO: 1488)
gaagtgatgctggtggagtctggggggaggcttagtgaagcctggagggtccctgaaactctcctgtgcagcctctgg attcactttcagt (amino acids)
(SEQ ID NO: 1489)
EVMLVESGGGLVKPGGSLKLSCAASGFTES Mouse 8C7F3 heavy chain variable complementarity determining regions 1 (CDR1)
sequence:
(DNA)
(SEQ ID NO: 1490)
acctatgccatgtct (amino acids)
(SEQ ID NO: 1491)
TYAMS Mouse 8C7F3 heavy chain variable framework 2 (FW2) sequence:
(DNA)
(SEQ ID NO: 1492)
tgggttcgccagactccggagaagaggctggagtgggtcgca (amino acids)
(SEQ ID NO: 1493)
WVRQTPEKRLEWVA Mouse 8C7F3 heavy chain variable complementarity determining regions 2 (CDR2)
sequence:
(DNA)
(SEQ ID NO: 1494)
gccattagtaatggtggtggttacacctactatccagacagtctgaagggg (amino acids)
(SEQ ID NO: 1495)
AISNGGGYTYYPDSLKG Mouse 8C7F3 heavy chain variable framework 3 (FW3) sequence:
(DNA)
(SEQ ID NO: 1496)
cgattcaccatctccagagacaatgccaagaacaccctgtacctgcaaatgagcagtctgaggtctgaggacacggc cacgtattactgtgcaaga (amino acids)
(SEQ ID NO: 1497)
RFTISRDNAKNTLYLQMSSLRSEDTATYYCAR Mouse 8C7F3 heavy chain variable complementarity determining regions 3 (CDR3)
sequence:
(DNA)
(SEQ ID NO: 1498)
cgttactatgatcactactttgactac (amino acids)
(SEQ ID NO: 1499)
RYYDHYFDY Mouse 8C7F3 heavy chain variable framework 4 (FW4) sequence:
(DNA)
(SEQ ID NO: 1500)
tggggccaaggcaccgctctcacggtctcctca (amino acids)
(SEQ ID NO: 1501)
WGQGTALTVSS Mouse 8C7F3 light chain variable framework 1 (FR1) sequence:
(DNA)
(SEQ ID NO: 1502)
atcattgtgctgacccaatctccagcttctttggctgtgtctctagggcagagggccaccatatcctgc (amino acids)
(SEQ ID NO: 1503)
IIVLTQSPASLAVSLGQRATISC -continued Mouse 8C7F3 light chain variable complementarity determining regions 1 (CDR1)
sequence:
(DNA)
                                                        (SEQ ID NO: 1504)
agagccagtgagagtgttgctacttatggcaataattttatgcag (amino acids)
                                                        (SEQ ID NO: 1505)
RASESVATYGNNFMQ Mouse 8C7F3 light chain variable framework 2 (FR2) sequence:
(DNA)
                                                        (SEQ ID NO: 1506)
tggtatcagcagaaaccaggacagccacccaaactcctcatctat (amino acids)
                                                        (SEQ ID NO: 1507)
WYQQKPGQPPKLLIY Mouse 8C7F3 light chain variable complementarity determining regions 2 (CDR2)
sequence:
(DNA)
                                                        (SEQ ID NO: 1508)
cttgcatccaccctagattct (amino acids)
                                                        (SEQ ID NO: 1509)
LASTLDS Mouse 8C7F3 light chain variable framework 3 (FR3) sequence:
(DNA)
                                                        (SEQ ID NO: 1510)
ggggtccctgccaggttcagtggcagtgggtctaggacagacttcaccctcaccattgatcctgtggaggctgatga tgctgcaacctattactgt (amino acids)
                                                        (SEQ ID NO: 1511)
GVPARFSGSGSRTDFTLTIDPVEADDAATYYC Mouse 8C7F3light chain variable complementarity determining regions 3 (CDR3)
sequence:
(DNA)
                                                        (SEQ ID NO: 1512)
cagcaaaataatgaggatcctccgacg (amino acids)
                                                        (SEQ ID NO: 1513)
QQNNEDPPT Mouse 8C7F3 light chain variable framework 4 (FR4) sequence:
(DNA)
                                                        (SEQ ID NO: 1514)
ttcggtggaggcaccaagctggaaatcaag (amino acids)
                                                        (SEQ ID NO: 1515)
FGGGTKLEIK Mouse H11 heavy chain variable framework 1 (FW1) sequence:
(DNA)
                                                        (SEQ ID NO: 1516)
gaagtggtgctggtggagtctggggggaggcttagtggagcctggagggtccctgaaactctcctgtgtagcctctgg attcgcttttagt (amino acids)
                                                        (SEQ ID NO: 1517)
EVVLVESGGGLVEPGGSLKLSCVASGFAFS Mouse H11 heavy chain variable complementarity determining regions 1 (CDR1)
Sequence:
(DNA)
                                                        (SEQ ID NO: 1518)
acctttgccatgtct (amino acids)
                                                        (SEQ ID NO: 1519)
TFAMS -continued Mouse H11 heavy chain variable framework 2 (FW2) sequence:
(DNA)

(SEQ ID NO: 1520)

tggattcgccagactccggagaagaggctggagtgggtcgca (amino acids)

(SEQ ID NO: 1521)

WIRQTPEKRLEWVA

Mouse H11 heavy chain variable complementarity determining regions 2 (CDR2)
Sequence:
(DNA)

(SEQ ID NO: 1522)

gccattagtaatggtggtggttacacttactatccagacactctgaaggggg (amino acids)

(SEQ ID NO: 1523)

AISNGGGYTYYPDTLKG

Mouse H11 heavy chain variable framework 3 (FW3) sequence:
(DNA)

(SEQ ID NO: 1524)

cgattcaccatctccagagacaatgccaagaataccctgtacctgcaaatgagtagtctgaggtctgaggacacggc cgtgtattactgtgcaaga (amino acids)

(SEQ ID NO: 1525)

RFTISRDNAKNTLYLQMSSLRSEDTAVYYCAR

Mouse H11 heavy chain variable complementarity determining regions 3 (CDR3)
Sequence:
(DNA)

(SEQ ID NO: 1526)

cgctactatgatctctactttgactta (amino acids)

(SEQ ID NO: 1527)

RYYDLYFDL

Mouse H11 heavy chain variable framework 4 (FW4) sequence:
(DNA)

(SEQ ID NO: 1528)

tggggccaaggcacctctctcatagtctcctca (amino acids)

(SEQ ID NO: 1529)

WGQGTSLIVSS

Mouse H11 light chain variable framework 1 (FR1) sequence:
(DNA)

(SEQ ID NO: 1530)

gatattctgatgacccaaactccactctccctgcctgtcagtcttggagatcaagcctccatttcttgc (amino acids)

(SEQ ID NO: 1531)

DILMTQTPLSLPVSLGDQASISC

Mouse H11 light chain variable complementarity determining regions 1 (CDR1)
Sequence:
(DNA)

(SEQ ID NO: 1532)

agatctagtcagaacattgtacatagtaatggaaacacctatttagaa (amino acids)

(SEQ ID NO: 1533)

RSSQNIVHSNGNTYLE

Mouse H11 light chain variable framework 2 (FR2) sequence:
(DNA)

(SEQ ID NO: 1534)

tggtacctgcagaaaccaggccagtctccaaagctcctgatctac (amino acids)

(SEQ ID NO: 1535)

WYLQKPGQSPKLLIY

-continued

Mouse H11 light chain variable complementarity determining regions 2 (CDR2)
sequence:
(DNA)

(SEQ ID NO: 1536)
aaagtttccaaccgattttct (amino acids)

(SEQ ID NO: 1537)
KVSNRFS

Mouse H11 light chain variable framework 3 (FR3) sequence:
(DNA)

(SEQ ID NO: 1538)
ggggtccccgacaggttcagtggtagtgggtcagggacagatttcacactcaagatcagcagagtggaggctgagga tctgggagtttattactgc (amino acids)

(SEQ ID NO: 1539)
GVPDRFSGSGSGTDFTLKISRVEAEDLGVYYC

Mouse H11 light chain variable complementarity determining regions 3 (CDR3)
sequence:
(DNA)

(SEQ ID NO: 1540)
tttcaagattcacatgttcctctcacg (amino acids)

(SEQ ID NO: 1541)
FQDSHVPLT

Mouse H11 light chain variable framework 4 (FR4) sequence:
(DNA)

(SEQ ID NO: 1542)
ttcggtgctgggaccaggctggagctgaaa (amino acids)

(SEQ ID NO: 1543)
FGAGTRLELK

Mouse B9 heavy chain variable framework 1 (FW1) sequence:
(DNA)

(SEQ ID NO: 1544)
gaggtgcaggtggtggagtctggggggagacttagtgaagcctggagggtccctgaaactctcctgtgcagcctctgg attcactttcagt (amino acids)

(SEQ ID NO: 1545)
EVQVVESGGDLVKPGGSLKLSCAASGFTFS

Mouse B9 heavy chain variable complementarity determining regions 1 (CDR1)
sequence:
(DNA)

(SEQ ID NO: 1546)
agatatggcatgtct (amino acids)

(SEQ ID NO: 1547)
RYGMS

Mouse B9 heavy chain variable framework 2 (FW2) sequence:
(DNA)

(SEQ ID NO: 1548)
tgggttcgccagactccagacaagaggctggagtgggtcgca (amino acids)

(SEQ ID NO: 1549)
WVRQTPDKRLEWVA

Mouse B9 heavy chain variable complementarity determining regions 2 (CDR2)
sequence:
(DNA)

(SEQ ID NO: 1550)
accattagtagtggtggtacttacatctactatccagacagtgtgaaggggg (amino acids)

(SEQ ID NO: 1551)
TISSGGTYIYYPDSVKG

-continued

Mouse B9 heavy chain variable framework 3 (FW3) sequence:
(DNA)

(SEQ ID NO: 1552)

cgattcaccatctccagagacaatgccaagaacaccctgtacctgcaaatgagcagtctgaagtctgaggacacagc catgtattactgtgca (amino acids)

(SEQ ID NO: 1553)

RFTISRDNAKNTLYLQMSSLKSEDTAMYYCAR

Mouse B9 heavy chain variable complementarity determining regions 3 (CDR3)
sequence:
(DNA)

(SEQ ID NO: 1554)

agggataactacggtagtagctacgactatgctatggactac (amino acids)

(SEQ ID NO: 1555)

DNYGSSYDYAMDY

Mouse B9 heavy chain variable framework 4 (FW4) sequence:
(DNA)

(SEQ ID NO: 1556)

tggggtcaaggaacctcagtcaccgtctcctct (amino acids)

(SEQ ID NO: 1557)

WGQGTSVTVSS

Mouse B9 light chain variable framework 1 (FR1) sequence:
(DNA)

(SEQ ID NO: 1558)

caaattgttctcacccagtctccagcaatcatgtctgcatctccaggggaggaggtcaccctaacctgc (amino acids)

(SEQ ID NO: 1559)

QIVLTQSPAIMSASPGEEVTLTC

Mouse B9 light chain variable complementarity determining regions 1 (CDR1)
sequence:
(DNA)

(SEQ ID NO: 1560)

agtgccagctcaagtgtaagttacatgcac (amino acids)

(SEQ ID NO: 1561)

SASSSVSYMH

Mouse B9 light chain variable framework 2 (FR2) sequence:
(DNA)

(SEQ ID NO: 1562)

tggttccagcagaggccaggcacttctcccaaactctggatttat (amino acids)

(SEQ ID NO: 1563)

WFQQRPGTSPKLWIY

Mouse B9 light chain variable complementarity determining regions 2 (CDR2)
sequence:
(DNA)

(SEQ ID NO: 1564)

accacatccaacctggcttct (amino acids)

(SEQ ID NO: 1565)

TTSNLAS

Mouse B9 light chain variable framework 3 (FR3) sequence:
(DNA)

(SEQ ID NO: 1566)

ggagtccctgctcgcttcagtggcagtggatctgggacctcttactctctcacaatcagccgaatggaggctgaaga tgctgccacttattactgc (amino acids)

(SEQ ID NO: 1567)

GVPARFSGSGSGTSYSLTISRMEAEDAATYYC

-continued

Mouse B9 light chain variable complementarity determining regions 3 (CDR3)
sequence:
(DNA)

(SEQ ID NO: 1568)

cagcaaaggagtagttacccattc (amino acids)

(SEQ ID NO: 1569)

QQRSSYPF

Mouse B9 light chain variable framework 4 (FR4) sequence:
(DNA)

(SEQ ID NO: 1570)

acgttcggctcggggacaaagttggaaataaaa (amino acids)

(SEQ ID NO: 1571)

TFGSGTKLEIK mu3C2B1 scFv- sequence
(DNA)

(SEQ ID NO: 1572)

Gaagtgatgctggtggagtctggggggaggcttagtgaagcctggagggtccctgaaactctcctgtgcagcctctgg aatcactttcagtacctataccatgtcgtgggttcgccagactccggagaagaggctggagtgggtcgcaaccatta gtactggtggtgataaaacctactattcagacagtgtgaaggggtcgattcaccatctccagagacaatgccaagaac aacctgtacctccaaatgagcagtctgaggtctgaggacacggccttgtattactgtgcaaggggaaccacggctat gtattactatgctatggactactgggtcaaggaacctcagtcaccgtctcctcaggtggcggaggatctggcggag gtggaagcggcggaggcggatccgacattgtgctgacacagtctcctgcttccttagctgtatctctggggcagagg gccaccatctcatgcagggccagcaaaagtatcagtacatctgactataattatattcactggtaccaacagaaacc aggacagccacccaaactcctcatctatcttgcatccaacctagaatctggggtccctgccaggttcagtggcagtg ggtctgggacagacttcacccctcaacatccatcctgtggaggaagaagatgctgcaacctattactgtcagcacagt agggagcttcctctcacgttcggtgctgggaccaagctggagctgaaa (amino acids)

(SEQ ID NO: 1573)

EVMLVESGGGLVKPGGSLKLSCAASGITFSTYTMSWVRQTPEKRLEWVATISTGGDKTYYSDSVKGRFTISRDNAKN

NLYLQMSSLRSEDTALYYCARGTTAMYYYAMDYWGQGTSVTVSSGGGGSGGGGSGGGGSDIVLTQSPASLAVSLGQR

ATISCRASKSISTSDYNYIHWYQQKPGQPPKLLIYLASNLESGVPARFSGSGSGTDFTLNIHPVEEEDAATYYCQHS

RELPLTFGAGTKLELK mu20A10 scFv- full sequence
(DNA)

(SEQ ID NO: 1574)

gaagtgatgctggtggaatctggcggcggactggttaagcctggcggatctctgaagctgagctgtgccgccagcgg cttcacctttagcacatacgccatgagctggatccggcagacccctgagaagagactggaatgggttgccagcatcg gcagagccggcagcacctactacagcgattctgtgaaggcagattcaccatcagccgggacaacgtgcggaacatc ctgtacctgcagatgagcagcctgcggagcgaggataccgccatgtactactgtgccagaggacccatctacaacga ctacgacgagttcgcctattggggccagggcacactggttacagtttctgctggtggcggaggatctggcggaggtg gaagcggcggaggcggatccaatatcatgatgacacagagcccagcagcctggctgtgtctgctggcgagaaagtg accatgtcctgcaagagcagccagagcgtgctgtactccagcaaccagaagaactacctggcctggtatcagcagaa gcccggccagtctcctaagctgctgatctactgggccagcaccagagaaagcggcgtgcccgatagattcacaggca gcggcagcggaaccgacttcaccctgacaatcagctctgtgcaggccgaagatctggccgtgtactattgccaccag tacctgtccagcctgacctttggcgccggaacaaagctggaactgaag (amino acids)

(SEQ ID NO: 1575)

EVMLVESGGGLVKPGGSLKLSCAASGFTFSTYAMSWIRQTPEKRLEWVASIGRAGSTYYSDSVKGRFTISRDNVRNI

LYLQMSSLRSEDTAMYYCARGPIYNDYDEFAYWGQGTLVTVSAGGGGSGGGGSGGGGSNIMMTQSPSSLAVSAGEKV

-continued

TMSCKSSQSVLYSSNQKNYLAWYQQKPGQSPKLLIYWASTRESGVPDRFTGSGSGTDFTLTISSVQAEDLAVYYCHQ

YLSSLTFGAGTKLELK hu20A10M scEV
(DNA)
                                                                    (SEQ ID NO: 1576)
gaggtgcagctggttgaatctggcggcggacttgtgaagcctggcggatctctgagactgagctgtgccgccagcgg cttcacctttagcacatacgccatgagctgggtccgacaggcccctggaaaaggccttgaatgggttgcctctatcg gcagagccggcagcacctactacagcgattctgtgaagggcagattcaccatcagccgggacaacgccaagaacagc ctgtacctgcagatgaactccctgagagccgaggacaccgccgtgtactattgtgccagaggacccatctacaacga ctacgacgagttcgcctattggggccagggcacactggtcacagtcagctctggcggtggcggaagcggaggcggtg gctccggtggcggaggcagcgacatcgtgatgacacagagcccttctagcctggccgtgtctctgggagagagagcc acaatcagctgcaagagcagccagagcgtgctgtactccagcaaccagaagaactacctggcctggtatcagcagaa gcccggacagtctcccaagctgctgatctactgggccagcaccagagaaagcggcgtgcccgatagattcacaggct ctggcagcggcaccgacttcaccctgacaattagcagtctgcaggccgaggacgtggccgtgtactactgtcaccag tacctgagcagcctgacctttggcggcggaacaaaggtggaaatcaag (amino acids)
                                                                    (SEQ ID NO: 1577)
EVQLVESGGGLVKPGGSLRLSCAASGFTFSTYAMSWVRQAPGKGLEWVASIGRAGSTYYSDSVKGRFTISRDNAKNS

LYLQMNSLRAEDTAVYYCARGPIYNDYDEFAYWGQGTLVTVSSGGGGSGGGGSGGGGSDIVMTQSPSSLAVSLGERA

TISCKSSQSVLYSSNQKNYLAWYQQKPGQSPKLLIYWASTRESGVPDRFTGSGSGTDFTLTISSLQAEDVAVYYCHQ

YLSSLTFGGGTKVEIK hu20A10C2 scEV
(DNA)
                                                                    (SEQ ID NO: 1578)
gaggtgcagctggttgaatctggcggcggacttgtgaagcctggcggatctctgagactgagctgtgccgccagcgg cttcacctttagcacatacgccatgagctgggtccgacaggcccctggaaaaggccttgaatgggttgcctctatcg gcagagccggcagcacctactacagcgattctgtgaagggcagattcaccatcagccgggacaacgccaagaacagc ctgtacctgcagatgaactccctgagagccgaggacaccgccgtgtactattgtgccagaggacccatctacaacga ctacgacgagttcgcctattggggccagggcacactggtcacagtcagctctggcggtggcggaagcggaggcggtg gctccggtggcggaggcagcgacattgtgctgacccagtctccagcctccttggccgtgtctccaggacagagggcc accatcacctgcaagagcagccagagcgtgctgtactccagcaaccagaagaactacctggcctggtatcagcagaa accaggacaacctcctaaactcctgatttactgggccagcaccagagaaagcggggtcccagccaggttcagcggca gtgggtctgggaccgatttcaccctcacaattaatcctgtggaagctaatgatactgcaaattattactgtcaccag tacctgagcagcctgaccttcggcggagggaccaaggtggagatcaaacga (amino acids)
                                                                    (SEQ ID NO: 1579)
EVQLVESGGGLVKPGGSLRLSCAASGFTFSTYAMSWVRQAPGKGLEWVASIGRAGSTYYSDSVKGRFTISRDNAKNS

LYLQMNSLRAEDTAVYYCARGPIYNDYDEFAYWGQGTLVTVSSGGGGSGGGGSGGGGSDIVLTQSPASLAVSPGQRA

TITCKSSQSVLYSSNQKNYLAWYQQKPGQPPKLLIYWASTRESGVPARFSGSGSGTDFTLTINPVEANDTANYYCHQ

YLSSLTFGGGTKVEIKR hu20A10N scEV
(DNA)
                                                                    (SEQ ID NO: 1580)
caggtgcagctggttgaatctggcggcggacttgtgaagcctggcggatctctgagactgagctgtgccgccagcgg cttcacctttagcacatacgccatgagctggatcagacaggcccctggcaaaggcctggaatgggtggcgtctattg gcagagccggcagcacctactacagcgactctgtgaagggcagattcaccatcagccgggacaacgccaagaacagc ctgtacctgcagatgaactccctgagagccgaggacaccgccgtgtactattgtgccagaggacccatctacaacga -continued

```
ctacgacgagttcgcctattggggccagggcacactggtcacagtttctagcggcggtggcggaagcggaggcggtg gctccggtggcggaggcagcgaaattgtgctgacacagagccccgccacactgtcactttctccaggcgaaagagcc acactgagctgcaagagcagccagagcgtgctgtactccagcaaccagaagaactacctggcctggtatcagcagaa gcccggccaagctcctcggctgctgatctattgggccagcacaagagagagcggcatccctgccagattttctggca gcggctctggcaccgatttcaccctgaccataagcagcctggaacctgaggacttcgccgtgtattactgccaccag tacctgagcagcctgacctttggcggaggcaccaaggtggaaatcaagcgg
```

(amino acids)

(SEQ ID NO: 1581)
```
QVQLVESGGGLVKPGGSLRLSCAASGFTFSTYAMSWIRQAPGKGLEWVASIGRAGSTYYSDSVKGRFTISRDNAKNS

LYLQMNSLRAEDTAVYYCARGPIYNDYDEFAYWGQGTLVTVSSGGGGSGGGGSGGGGSEIVLTQSPATLSLSPGERA

TLSCKSSQSVLYSSNQKNYLAWYQQKPGQAPRLLIYWASTRESGIPARFSGSGSGTDFTLTISSLEPEDFAVYYCHQ

YLSSLTFGGGTKVEIKR
``` mu20A10-CAR T-8-4-1BB-3z
(DNA)

(SEQ ID NO: 1582)
```
atggcccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaacccctgcccccagacctcctacccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtgggtccttctcctgtcactggttatcac cctttactgcaaacggggcagaaagaaactcctgtatatattcaaacaaccatttatgagaccagtacaaactactc aagaggaagatggctgtagctgccgatttccagaagaagaagaaggaggatgtgaactgagagtgaagttcagcagg agcgcagacgcccccgcgtacaagcagggccagaaccagctctataacgagctcaatctaggacgaagagaggagta cgatgttttggacaagagacgtggccgggaccctgagatggggggaaagccgagaaggaagaaccctcaggaaggcc tgtacaatgaactgcagaaagataagatggcggaggcctacagtgagattgggatgaaaggcgagcgccggagggc aagggggcacgatggcctttaccagggtctcagtacagccaccaaggacacctacgacgcccttcacatgcaggccct gccccctcgctgataa
```

(amino acis)

(SEQ ID NO: 1583)
```
MALPVTALLLPLALLLHAARPEVMLVESGGGLVKPGGSLKLSCAASGFTESTYAMSWIRQTPEKRLEWVASIGRAGS

TYYSDSVKGRFTISRDNVRNILYLQMSSLRSEDTAMYYCARGPIYNDYDEFAYWGQGTLVTVSAGGGGSGGGGSGGGG

GSNIMMTQSPSSLAVSAGEKVTMSCKSSQSVLYSSNQKNYLAWYQQKPGQSPKLLIYWASTRESGVPDRFTGSGSGT

DFTLTISSVQAEDLAVYYCHQYLSSLTFGAGTKLELKTTTPAPRPPTPAPTIASQPLSLRPEACRPAAGGAVHTRGL

DFACDIYIWAPLAGTCGVLLLSLVITLYCKRGRKKLLYIFKQPFMRPVQTTQEEDGCSCRFPEEEEGGCELRVKFSR

SADAPAYKQGQNQLYNELNLGRREEYDVLDKRRGRDPEMGGKPRRKNPQEGLYNELQKDKMAEAYSEIGMKGERRRG

KGHDGLYQGLSTATKDTYDALHMQALPPR**
```

-continued hu20A10-CAR T-8-4-1BB-3z
(DNA)

(SEQ ID NO: 1584)
atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcggagggaccaaggtggagatcaaacgaacaacaacccctgcccccagacctcctaccccagcccta caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat caccctttactgcaaacggggcagaaagaaactcctgtatatattcaaacaaccatttatgagaccagtacaaacta ctcaagaggaagatggctgtagctgccgatttccagaagaagaagaaggaggatgtgaactgagagtgaagttcagc aggagcgcagacgcccccgcgtacaagcagggccagaaccagctctataacgagctcaatctaggacgaagagagga gtacgatgtttggacaagagacgtggccgggaccctgagatggggggaaagccgagaaggaagaaccctcaggaag gcctgtacaatgaactgcagaaagataagatggcggaggcctacagtgagattgggatgaaaggcgagcgccggagg ggcaaggggcacgatggcctttaccagggtctcagtacagccaccaaggacacctacgacgcccttcacatgcaggc cctgccccctcgctgataa (amino acids)

(SEQ ID NO: 1585)
MALPVTALLLPLALLLHAARPEVQLVESGGGLVKPGGSLRLSCAASGFTESTYAMSWVRQAPGKGLEWVASIGRAGS

TYYSDSVKGRFTISRDNAKNSLYLQMNSLRAEDTAVYYCARGPIYNDYDEFAYWGQGTLVTVSSGGGGSGGGGSGGG

GSDIVLTQSPASLAVSPGQRATITCKSSQSVLYSSNQKNYLAWYQQKPGQPPKLLIYWASTRESGVPARFSGSGSGT

DFTLTINPVEANDTANYYCHQYLSSLTEGGGTKVEIKRTTTPAPRPPTPAPTIASQPLSLRPEACRPAAGGAVHTRG

LDFACDIYIWAPLAGTCGVLLLSLVITLYCKRGRKKLLYIFKQPFMRPVQTTQEEDGCSCRFPEEEEGGCELRVKFS

RSADAPAYKQGQNQLYNELNLGRREEYDVLDKRRGRDPEMGGKPRRKNPQEGLYNELQKDKMAEAYSEIGMKGERRR

GKGHDGLYQGLSTATKDTYDALHMQALPPR** mu20A10-CAR T-8-28-3z
(DNA)

(SEQ ID NO: 1586)
atggccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc -continued gacttcaccctgacaatcagctctgtgcaggccgaagatctggccgtgtactattgccaccagtacctgtccagcct gacctttggcgccggaacaaagctggaactgaagacaacaaccctgcccccagacctcctaccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtggggtccttctcctgtcactggttatcac cctttactgcaggagtaagaggagcaggctcctgcacagtgactacatgaacatgactcctagaagacctgggccta ccagaaagcattaccagccctatgccccaccacgcgacttcgcagcctatcgctccagagtgaagttcagcaggagc gcagacgcccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt acaatgaactgcagaaagataagatggcggaggcctacagtgagattgggatgaaaggcgagcgccggaggggcaag gggcacgatggcctttaccagggtctcagtacagccaccaaggacacctacgacgcccttcacatgcaggccctgcc ccctcgctgataa (amino acids)

(SEQ ID NO: 1587)

MALPVTALLLPLALLLHAARPEVMLVESGGGLVKPGGSLKLSCAASGFTESTYAMSWIRQTPEKRLEWVASIGRAGS

TYYSDSVKGRFTISRDNVRNILYLQMSSLRSEDTAMYYCARGPIYNDYDEFAYWGQGTLVTVSAGGGGSGGGGSGGG

GSNIMMTQSPSSLAVSAGEKVTMSCKSSQSVLYSSNQKNYLAWYQQKPGQSPKLLIYWASTRESGVPDRFTGSGSGT

DFTLTISSVQAEDLAVYYCHQYLSSLTFGAGTKLELKTTTPAPRPPTPAPTIASQPLSLRPEACRPAAGGAVHTRGL

DFACDIYIWAPLAGTCGVLLLSLVITLYCRSKRSRLLHSDYMNMTPRRPGPTRKHYQPYAPPRDFAAYRSRVKFSRS

ADAPAYKQGQNQLYNELNLGRREEYDVLDKRRGRDPEMGGKPRRKNPQEGLYNELQKDKMAEAYSEIGMKGERRRGK

GHDGLYQGLSTATKDTYDALHMQALPPR** hu20A10-CAR T-8-28-3z
(DNA)

(SEQ ID NO: 1588)

atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcgcgagggaccaaggtggagatcaaacgaacaacaaccctgcccccagacctcctaccccagcccta caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat cacccctttactgcaggagtaagaggagcaggctcctgcacagtgactacatgaacatgactcctagaagacctgggc ctaccagaaagcattaccagccctatgcccaccacgcgacttcgcagcctatcgctccagagtgaagttcagcagg agcgcagacgcccccgcgtacaagcagggccagaaccagctctataacgagctcaatctaggacgaagagaggagta cgatgttttggacaagagacgtggccgggaccctgagatggggggaaagccgagaaggaagaaccctcaggaaggcc tgtacaatgaactgcagaaagataagatggcggaggcctacagtgagattgggatgaaaggcgagcgccggaggggc aaggggcacgatggcctttaccagggtctcagtacagccaccaaggacacctacgacgcccttcacatgcaggccct gcccctcgctgataa -continued (amino acids)

(SEQ ID NO: 1589)

MALPVTALLLPLALLLHAARPEVQLVESGGGLVKPGGSLRLSCAASGFTESTYAMSWVRQAPGKGLEWVASIGRAGS

TYYSDSVKGRFTISRDNAKNSLYLQMNSLRAEDTAVYYCARGPIYNDYDEFAYWGQGTLVTVSSGGGGSGGGGSGGGG

GSDIVLTQSPASLAVSPGQRATITCKSSQSVLYSSNQKNYLAWYQQKPGQPPKLLIYWASTRESGVPARFSGSGSGT

DFTLTINPVEANDTANYYCHQYLSSLTEGGGTKVEIKRTTTPAPRPPTPAPTIASQPLSLRPEACRPAAGGAVHTRG

LDFACDIYIWAPLAGTCGVLLLSLVITLYCRSKRSRLLHSDYMNMTPRRPGPTRKHYQPYAPPRDFAAYRSRVKFSR

SADAPAYKQGQNQLYNELNLGRREEYDVLDKRRGRDPEMGGKPRRKNPQEGLYNELQKDKMAEAYSEIGMKGERRRG

KGHDGLYQGLSTATKDTYDALHMQALPPR** mu20A10-CAR T-8-4-1BB-3z-1XX
(DNA)

(SEQ ID NO: 1590)

atggccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaacccctgcccccagacctcctaccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtgggtccttctcctgtcactggttatcac cctttactgcaaacggggcagaaagaaactcctgtatatattcaaacaaccatttatgagaccagtacaaactactc aagaggaagatggctgtagctgccgatttccagaagaagaagaaggaggatgtgaactgagagtgaagttcagcagg agcgcagacgcccccgcgtacaagcagggccagaaccagctctataacgagctcaatctaggacgaagagaggagta cgatgtttggacaagagacgtggccgggaccctgagatggggggaaagccgagaaggaagaaccctcaggaaggcc tgttcaatgaactgcagaaagataagatggcggaggcctcagtgagattgggatgaaaggcgagcgccggagggc aaggggcacgatggccttttccagggtctcagtacagccaccaaggacaccttcgacgcccttcacatgcaggccct gcccctcgctgataa (DNA)

(SEQ ID NO: 1591)

MALPVTALLLPLALLLHAARPEVMLVESGGGLVKPGGSLKLSCAASGFTESTYAMSWIRQTPEKRLEWVASIGRAGS

TYYSDSVKGRFTISRDNVRNILYLQMSSLRSEDTAMYYCARGPIYNDYDEFAYWGQGTLVTVSAGGGGSGGGGSGGGG

GSNIMMTQSPSSLAVSAGEKVTMSCKSSQSVLYSSNQKNYLAWYQQKPGQSPKLLIYWASTRESGVPDRFTGSGSGT

DFTLTISSVQAEDLAVYYCHQYLSSLTFGAGTKLELKTTTPAPRPPTPAPTIASQPLSLRPEACRPAAGGAVHTRGL

DFACDIYIWAPLAGTCGVLLLSLVITLYCKRGRKKLLYIFKQPFMRPVQTTQEEDGCSCREPEEEEGGCELRVKFSR

SADAPAYKQGQNQLYNELNLGRREEYDVLDKRRGRDPEMGGKPRRKNPQEGLENELQKDKMAEAFSEIGMKGERRRG

KGHDGLFQGLSTATKDTFDALHMQALPPR** hu20A10-CAR T-8-4-1BB-3z-1XX
(DNA)

(SEQ ID NO: 1592)

atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca -continued catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcggagggaccaaggtggagatcaaacgaacaacaacccctgccccagacctcctaccccagccccta caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat cacccttactgcaaacggggcagaaagaaactcctgtatatattcaaacaaccatttatgagaccagtacaaacta ctcaagaggaagatggctgtagctgccgatttccagaagaagaagaaggaggatgtgaactgagagtgaagttcagc aggagcgcagacgcccccgcgtacaagcagggccagaaccagctctataacgagctcaatctaggacgaagagagga gtacgatgtttttggacaagagacgtggccgggaccctgagatggggggaaagccgagaaggaagaaccctcaggaag gcctgttcaatgaactgcagaaagataagatggcggaggccttcagtgagattgggatgaaaggcgagcgccggagg ggcaaggggcacgatggcctttttccagggtctcagtacagccaccaaggacaccttcgacgcccttcacatgcaggc cctgccccctcgctgataa (amino acids)

(SEQ ID NO: 1593)

MALPVTALLLPLALLLHAARPEVQLVESGGGLVKPGGSLRLSCAASGFTESTYAMSWVRQAPGKGLEWVASIGRAGS

TYYSDSVKGRFTISRDNAKNSLYLQMNSLRAEDTAVYYCARGPIYNDYDEFAYWGQGTLVTVSSGGGGSGGGGSGGGG

GSDIVLTQSPASLAVSPGQRATITCKSSQSVLYSSNQKNYLAWYQQKPGQPPKLLIYWASTRESGVPARFSGSGSGT

DFTLTINPVEANDTANYYCHQYLSSLTEGGGTKVEIKRTTTPAPRPPTPAPTIASQPLSLRPEACRPAAGGAVHTRG

LDFACDIYIWAPLAGTCGVLLLSLVITLYCKRGRKKLLYIFKQPFMRPVQTTQEEDGCSCRFPEEEEGGCELRVKFS

RSADAPAYKQGQNQLYNELNLGRREEYDVLDKRRGRDPEMGGKPRRKNPQEGLFNELQKDKMAEAFSEIGMKGERRR

GKGHDGLFQGLSTATKDTFDALHMQALPPR** mu20A10-CAR T-8-28-3z-1XX
(DNA)

(SEQ ID NO: 1594)

atggccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaacccctgccccagacctcctaccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtggggtccttctcctgtcactggttatcac -continued cctttactgcaggagtaagaggagcaggctcctgcacagtgactacatgaacatgactcctagaagacctgggcctca ccagaaagcattaccagccctatgccccaccacgcgacttcgcagcctatcgctccagagtgaagttcagcaggagc gcagacgccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt tcaatgaactgcagaaagataagatggcggaggccttcagtgagattgggatgaaaggcgagcgccggaggggcaag gggcacgatggcctttttccagggtctcagtacagccaccaaggacaccttcgacgcccttcacatgcaggccctgcc ccctcgctgataa (amino acids)

(SEQ ID NO: 1595)
MALPVTALLLPLALLLHAARPEVMLVESGGGLVKPGGSLKLSCAASGFTESTYAMSWIRQTPEKRLEWVASIGRAGS

TYYSDSVKGRFTISRDNVRNILYLQMSSLRSEDTAMYYCARGPIYNDYDEFAYWGQGTLVTVSAGGGGSGGGGSGGGG

GSNIMMTQSPSSLAVSAGEKVTMSCKSSQSVLYSSNQKNYLAWYQQKPGQSPKLLIYWASTRESGVPDRFTGSGSGT

DFTLTISSVQAEDLAVYYCHQYLSSLTFGAGTKLELKTTTPAPRPPTPAPTIASQPLSLRPEACRPAAGGAVHTRGL

DFACDIYIWAPLAGTCGVLLLSLVITLYCRSKRSRLLHSDYMNMTPRRPGPTRKHYQPYAPPRDFAAYRSRVKFSRS

ADAPAYKQGQNQLYNELNLGRREEYDVLDKRRGRDPEMGGKPRRKNPQEGLENELQKDKMAEAFSEIGMKGERRRGK
GHDGLFQGLSTATKDTFDALHMQALPPR** hu20A10-CAR T-8-28-3z-1XX
(DNA)
(SEQ ID NO: 1596)
atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcggagggaccaaggtggagatcaaacgaacaacaacccctgcccccagacctcctaccccagcccta caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat caccctttactgcaggagtaagaggagcaggctcctgcacagtgactacatgaacatgactcctagaagacctgggc ctaccagaaagcattaccagccctatgccccaccacgcgacttcgcagcctatcgctccagagtgaagttcagcagg agcgcagacgccccgcgtacaagcagggccagaaccagctctataacgagctcaatctaggacgaagagaggagta cgatgttttggacaagagacgtggccgggaccctgagatggggggaaagccgagaaggaagaaccctcaggaaggcc tgttcaatgaactgcagaaagataagatggcggaggccttcagtgagattgggatgaaaggcgagcgccggaggggc aaggggcacgatggcctttttccagggtctcagtacagccaccaaggacaccttcgacgcccttcacatgcaggccct gccccctcgctgataa (amino acids)

(SEQ ID NO: 1597)
MALPVTALLLPLALLLHAARPEVQLVESGGGLVKPGGSLRLSCAASGFTFSTYAMSWVRQAPGKGLEWVASIGRAGS

TYYSDSVKGRFTISRDNAKNSLYLQMNSLRAEDTAVYYCARGPIYNDYDEFAYWGQGTLVTVSSGGGGSGGGGSGGGG

GSDIVLTQSPASLAVSPGQRATITCKSSQSVLYSSNQKNYLAWYQQKPGQPPKLLIYWASTRESGVPARFSGSGSGT

-continued

DFTLTINPVEANDTANYYCHQYLSSLTFGGGTKVEIKRTTTPAPRPPTPAPTIASQPLSLRPEACRPAAGGAVHTRG

LDFACDIYIWAPLAGTCGVLLLSLVITLYCRSKRSRLLHSDYMNMTPRRPGPTRKHYQPYAPPRDFAAYRSRVKFSR

SADAPAYKQGQNQLYNELNLGRREEYDVLDKRRGRDPEMGGKPRRKNPQEGLENELQKDKMAEAFSEIGMKGERRRG

KGHDGLFQGLSTATKDTFDALHMQALPPR**

25E6
mu25E6 scFv- full sequence
(DNA)
                                                              (SEQ ID NO: 1598)
gaggtgcagctggtggagtctgggggagacttagtgaagcctggagggtccctgaaactctcctgtgcagcctctgg tttcactttcagtagttatggaatgtcttgggttcgccagactccagacaagaggctggagtgggtcgcaaccatta gtaatggtggtagacacaccttctatccagacagtgtgaaggggcgattcaccatctccagagacaatgccaagaac accctgtatctgcaaatgagcagtctgaagtctgaggacacagccatgtatttatgtgtaagacagactgggacgga gggctggtttgcttactggggccaagggactctggtcactgtctctgcaggtggcggaggatctggcggaggtggaa gcggcggaggcggatccgatgttgtgatgacccagactccactcactttgtcggttaccattggacaaccagcctcc atctcttgcaagtcaagtcagagcctcttagatagtgatggaaagacatatttgaattggttgttacagaggccagg ccagtctccaaagcgcctaatctatctggtgtctaaactggactctggagtccctgacaggttcactggcagtggat cagggacagatttcacactgaaaatcagcagagtggaggctgaggatttgggagtttattattgctggcaaggtaca cattttcctcagacgttcggtggaggcaccaagctggaaatcaaa (amino acids)
                                                              (SEQ ID NO: 1599)
EVQLVESGGDLVKPGGSLKLSCAASGFTFSSYGMSWVRQTPDKRLEWVATISNGGRHTFYPDSVKGRFTISRDNAKN

TLYLQMSSLKSEDTAMYLCVRQTGTEGWFAYWGQGTLVTVSAGGGGSGGGGSGGGGSDVVMTQTPLTLSVTIGQPAS

ISCKSSQSLLDSDGKTYLNWLLQRPGQSPKRLIYLVSKLDSGVPDRFTGSGSGTDFTLKISRVEAEDLGVYYCWQGT

HFPQTFGGGTKLEIK hu25E6 full sequence
(DNA)
                                                              (SEQ ID NO: 1600)
gaggtgcagctggtggaatctggcggaggactggtcaagcctggaggcagcctgagactgagctgcgccgccagcgg cttcacattcagcagctacggcatgagctgggtgcggcaggcccctggcaagggcctggaatgggtcagcaccatca gcaacggcggaagacacacacttctaccccgacagcgtgaagggcagattcaccatctcaagagataacgccaagaac agcctgtacctgcagatgaacagcctgcgggccgaggacaccgccgtgtactactgcgccagacagaccggcacaga gggctggttcgcctactggggccagggcaccctggtgaccgtgtccagcggcggtggcggaagcggaggcggtggct ccggtggcggaggcagcgacatcgtgatgacccagacccctctgtctctgagcgtgacccctggccagcctgccagc atctcttgtaaaagcagccagagcctgctggacagcgacggcaagacctacctgaactggtacctgcagaagcccgg ccaaagccctcagctgctgatctacctggtgtccaagctggatagcggtgttcctgatagattcagcggatctggca gcggcaccgacttcaccctgaagatcagcagagtggaagccgaggacgtgggcgtgtactactgctggcagggcaca cacttcccccagacattcggccagggcaccaaggtggaaatcaag (amino acids)
                                                              (SEQ ID NO: 1601)
EVQLVESGGGLVKPGGSLRLSCAASGFTFSSYGMSWVRQAPGKGLEWVSTISNGGRHTFYPDSVKGRFTISRDNAKN

SLYLQMNSLRAEDTAVYYCARQTGTEGWFAYWGQGTLVTVSSGGGGSGGGGSGGGGSDIVMTQTPLSLSVTPGQPAS

ISCKSSQSLLDSDGKTYLNWYLQKPGQSPQLLIYLVSKLDSGVPDRFSGSGSGTDFTLKISRVEAEDVGVYYCWQGT

HFPQTFGQGTKVEIK

-continued mu25E6-CAR T-8-4-1BB-3z
(DNA)

(SEQ ID NO: 1602)

atggccttaccagtgaccgccttgctcctgccgctggccttgctgctccacgccgccaggccggaggtgcagctggt ggagtctgggggagacttagtgaagcctggagggtccctgaaactctcctgtgcagcctctggttttcactttcagta gttatggaatgtcttgggttcgccagactccagacaagaggctggagtgggtcgcaaccattagtaatggtggtaga cacaccttctatccagacagtgtgaagggccgattcaccatctccagagacaatgccaagaacaccctgtatctgca aatgagcagtctgaagtctgaggacacagccatgtatttatgtgtaagacagactgggacggagggctggtttgctt actgggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggattgggagtttattattgctggcaaggtacacattttcctcagac gttcggtggaggcaccaagctggaaatcaaaacaacaaccctgcccccagacctcctaccccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgtttggacaagagacgtggccgggaccctgagatggggggaaagccgagaaggaagaaccctcaggaaggcctgt acaatgaactgcagaaagataagatggcggaggcctacagtgagattgggatgaaaggcgagcgccggaggggcaag gggcacgatggcctttaccagggtctcagtacagccaccaaggacacctacgacgcccttcacatgcaggccctgcc ccctcgctgataa (amino acids)

(SEQ ID NO: 1603)

MALPVTALLLPLALLLHAARPEVQLVESGGDLVKPGGSLKLSCAASGFTESSYGMSWVRQTPDKRLEWVATISNGGR

HTFYPDSVKGRFTISRDNAKNTLYLQMSSLKSEDTAMYLCVRQTGTEGWFAYWGQGTLVTVSAGGGGSGGGGSGGGG

SDVVMTQTPLTLSVTIGQPASISCKSSQSLLDSDGKTYLNWLLQRPGQSPKRLIYLVSKLDSGVPDRFTGSGSGTDF

TLKISRVEAEDLGVYYCWQGTHFPQTEGGGTKLEIKTTTPAPRPPTPAPTIASQPLSLRPEACRPAAGGAVHTRGLD

FACDIYIWAPLAGTCGVLLLSLVITLYCKRGRKKLLYIFKQPFMRPVQTTQEEDGCSCRFPEEEEGGCELRVKFSRS

ADAPAYKQGQNQLYNELNLGRREEYDVLDKRRGRDPEMGGKPRRKNPQEGLYNELQKDKMAEAYSEIGMKGERRRGK

GHDGLYQGLSTATKDTYDALHMQALPPR** hu25E6-CAR T-8-4-1BB-3z (SEQ ID NO: 1604)

atggccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actgggccagggcaccctggtgaccgtgtccagcggcggtggcggaagcggaggcggtggctccggtggcggaggc agcgacatcgtgatgacccagacccctctgtctctgagcgtgacccctggccagcctgccagcatctcttgtaaaag cagccagagcctgctggacagcgacggcaagacctacctgaactggtacctgcagaagcccggccaaagccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac -continued attcggccagggcaccaaggtggaaatcaagacaacaacccctgcccccagacctcctaccccagccccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt acaatgaactgcagaaagataagatggcggaggcctacagtgagattgggatgaaaggcgagcgccggaggggcaag gggcacgatggcctttaccagggtctcagtacagccaccaaggacacctacgacgcccttcacatgcaggccctgcc ccctcgctgataa (amino acids)

(SEQ ID NO: 1605)

MALPVTALLLPLALLLHAARPEVQLVESGGGLVKPGGSLRLSCAASGFTESSYGMSWVRQAPGKGLEWVSTISNGGR

HTFYPDSVKGRFTISRDNAKNSLYLQMNSLRAEDTAVYYCARQTGTEGWFAYWGQGTLVTVSSGGGGSGGGGSGGGG

SDIVMTQTPLSLSVTPGQPASISCKSSQSLLDSDGKTYLNWYLQKPGQSPQLLIYLVSKLDSGVPDRFSGSGSGTDF

TLKISRVEAEDVGVYYCWQGTHFPQTFGQGTKVEIKTTTPAPRPPTPAPTIASQPLSLRPEACRPAAGGAVHTRGLD

FACDIYIWAPLAGTCGVLLLSLVITLYCKRGRKKLLYIFKQPFMRPVQTTQEEDGCSCRFPEEEEGGCELRVKFSRS

ADAPAYKQGQNQLYNELNLGRREEYDVLDKRRGRDPEMGGKPRRKNPQEGLYNELQKDKMAEAYSEIGMKGERRRGK

GHDGLYQGLSTATKDTYDALHMQALPPR** mu25E6-CAR T-8-28-3z (SEQ ID NO: 1606)

atggcccttaccagtgaccgccttgctcctgccgctggccttgctgctccacgccgccaggccggaggtgcagctggt ggagtctggggggagacttagtgaagcctggagggtccctgaaactctcctgtgcagcctctggttttcactttcagta gttatggaatgtcttgggttcgccagactccagacaagaggctggagtgggtcgcaaccattagtaatggtggtaga cacacccttctatccagacagtgtgaaggggcgattcaccatctccagagacaatgccaagaacaccctgtatctgca aatgagcagtctgaagtctgaggacacagccatgtatttatgtgtaagacagactgggacggagggctggtttgctt actggggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaacccctgcccccagacctcctaccccagccccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgccccaccacgcgacttcgcagcctatcgctccagagtgaagttcagcaggagcgca gacgcccccgcgtacaagcagggccagaaccagctctataacgagctcaatctaggacgaagagaggagtacgatgt tttggacaagagacgtggccgggaccctgagatggggggaaagccgagaaggaagaaccctcaggaaggcctgtaca atgaactgcagaaagataagatggcggaggcctacagtgagattgggatgaaaggcgagcgccggaggggcaagggg cacgatggcctttaccagggtctcagtacagccaccaaggacacctacgacgcccttcacatgcaggccctgccccc tcgctgataa -continued (amino acids)

(SEQ ID NO: 1607)

MALPVTALLLPLALLLHAARPEVQLVESGGDLVKPGGSLKLSCAASGFTESSYGMSWVRQTPDKRLEWVATISNGGR

HTFYPDSVKGRFTISRDNAKNTLYLQMSSLKSEDTAMYLCVRQTGTEGWFAYWGQGTLVTVSAGGGGSGGGGSGGGG

SDVVMTQTPLTLSVTIGQPASISCKSSQSLLDSDGKTYLNWLLQRPGQSPKRLIYLVSKLDSGVPDRFTGSGSGTDF

TLKISRVEAEDLGVYYCWQGTHFPQTEGGGTKLEIKTTTPAPRPPTPAPTIASQPLSLRPEACRPAAGGAVHTRGLD

FACDIYIWAPLAGTCGVLLLSLVITLYCRSKRSRLLHSDYMNMTPRRPGPTRKHYQPYAPPRDFAAYRSRVKFSRSA

DAPAYKQGQNQLYNELNLGRREEYDVLDKRRGRDPEMGGKPRRKNPQEGLYNELQKDKMAEAYSEIGMKGERRRGKG

HDGLYQGLSTATKDTYDALHMQALPPR** hu25E6-CAR T-8-28-3z (SEQ ID NO: 1608)

atggccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actggggccagggcaccctggtgaccgtgtccagcggcggtggcggaagcggaggcggtggctccggtggcggaggc agcgacatcgtgatgacccagacccctctgtctctgagcgtgaccctggccagcctgccagcatctcttgtaaaag cagcagagcctgctggacagcgacggcaagacctacctgaactggtacctgcagaagcccggccaaagccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaacccctgcccccagacctcctaccccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgcccaccacgcgacttcgcagcctatcgctccagagtgaagttcagcaggagcgca gacgcccccgcgtacaagcagggccagaaccagctctataacgagctcaatctaggacgaagagaggagtacgatgt tttggacaagagacgtggccgggaccctgagatggggggaaagccgagaaggaagaaccctcaggaaggcctgtaca atgaactgcagaaagataagatggcggaggcctacagtgagattgggatgaaaggcgagcgccggaggggcaagggg cacgatggcctttaccagggtctcagtacagccaccaaggacacctacgacgcccttcacatgcaggccctgccccc tcgctgataa (amino acids)

(SEQ ID NO: 1609)

MALPVTALLLPLALLLHAARPEVQLVESGGGLVKPGGSLRLSCAASGFTESSYGMSWVRQAPGKGLEWVSTISNGGR

HTFYPDSVKGRFTISRDNAKNSLYLQMNSLRAEDTAVYYCARQTGTEGWFAYWGQGTLVTVSSGGGGSGGGGSGGGG

SDIVMTQTPLSLSVTPGQPASISCKSSQSLLDSDGKTYLNWYLQKPGQSPQLLIYLVSKLDSGVPDRFSGSGSGTDF

TLKISRVEAEDVGVYYCWQGTHFPQTFGQGTKVEIKTTTPAPRPPTPAPTIASQPLSLRPEACRPAAGGAVHTRGLD

FACDIYIWAPLAGTCGVLLLSLVITLYCRSKRSRLLHSDYMNMTPRRPGPTRKHYQPYAPPRDFAAYRSRVKFSRSA

DAPAYKQGQNQLYNELNLGRREEYDVLDKRRGRDPEMGGKPRRKNPQEGLYNELQKDKMAEAYSEIGMKGERRRGKG

HDGLYQGLSTATKDTYDALHMQALPPR** mu25E6-CAR T-8-4-1BB-3z-1XX (SEQ ID NO: 1610)

atggccttaccagtgaccgccttgctcctgccgctggccttgctgctccacgccgccaggccggaggtgcagctggt ggagtctggggggagacttagtgaagcctggagggtccctgaaactctcctgtgcagcctctggtttcactttcagta -continued

```
gttatggaatgtcttgggttcgccagactccagacaagaggctggagtgggtcgcaaccattagtaatggtggtaga cacaccttctatccagacagtgtgaaggggcgattcaccatctccagagacaatgccaagaacaccctgtatctgca aatgagcagtctgaagtctgaggacacagccatgtatttatgtgtaagacagactgggacggagggctggtttgctt actggggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaacccctgcccccagacctcctacccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgtttttggacaagagacgtggccgggaccctgagatggggggaaagccgagaaggaagaaccctcaggaaggcctgt tcaatgaactgcagaaagataagatggcggaggccttcagtgagattgggatgaaaggcgagcgccggaggggcaag gggcacgatggcctttttccagggtctcagtacagccaccaaggacaccttcgacgcccttcacatgcaggccctgcc ccctcgctgataa
```

(amino acids)
                                                                       (SEQ ID NO: 1611)
```
MALPVTALLLPLALLLHAARPEVQLVESGGDLVKPGGSLKLSCAASGFTESSYGMSWVRQTPDKRLEWVATISNGGR

HTFYPDSVKGRFTISRDNAKNTLYLQMSSLKSEDTAMYLCVRQTGTEGWFAYWGQGTLVTVSAGGGGSGGGGSGGGG

SDVVMTQTPLTLSVTIGQPASISCKSSQSLLDSDGKTYLNWLLQRPGQSPKRLIYLVSKLDSGVPDRFTGSGSGTDF

TLKISRVEAEDLGVYYCWQGTHFPQTEGGGTKLEIKTTTPAPRPPTPAPTIASQPLSLRPEACRPAAGGAVHTRGLD

FACDIYIWAPLAGTCGVLLLSLVITLYCKRGRKKLLYIFKQPFMRPVQTTQEEDGCSCREPEEEEGGCELRVKFSRS

ADAPAYKQGQNQLYNELNLGRREEYDVLDKRRGRDPEMGGKPRRKNPQEGLENELQKDKMAEAFSEIGMKGERRRGK

GHDGLFQGLSTATKDTFDALHMQALPPR**
``` hu25E6-CAR T-8-4-1BB-3z-1XX
                                                                       (SEQ ID NO: 1612)
```
atggcccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actggggccagggcaccctggtgaccgtgtccagcggcggtggcggaagcggaggcggtggctccggtggcggaggc agcgacatcgtgatgacccagacccctctgtctctgagcgtgaccccctggccagcctgccagcatctcttgtaaaag cagccagagcctgctggacagcgacggcaagacctacctgaactggtacctgcagaagcccggccaaagccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaacccctgcccccagacctcctacccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag
```

-continued aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt tcaatgaactgcagaaagataagatggcggaggccttcagtgagattgggatgaaaggcgagcgccggaggggcaag gggcacgatggccttttccagggtctcagtacagccaccaaggacaccttcgacgcccttcacatgcaggccctgcc ccctcgctgataa (amino acids)

(SEQ ID NO: 1613)
MALPVTALLLPLALLLHAARPEVQLVESGGGLVKPGGSLRLSCAASGFTESSYGMSWVRQAPGKGLEWVSTISNGGR

HTFYPDSVKGRFTISRDNAKNSLYLQMNSLRAEDTAVYYCARQTGTEGWFAYWGQGTLVTVSSGGGGSGGGGSGGGG

SDIVMTQTPLSLSVTPGQPASISCKSSQSLLDSDGKTYLNWYLQKPGQSPQLLIYLVSKLDSGVPDRFSGSGSGTDF

TLKISRVEAEDVGVYYCWQGTHFPQTFGQGTKVEIKTTTPAPRPPTPAPTIASQPLSLRPEACRPAAGGAVHTRGLD

FACDIYIWAPLAGTCGVLLLSLVITLYCKRGRKKLLYIFKQPFMRPVQTTQEEDGCSCRFPEEEEGGCELRVKFSRS

ADAPAYKQGQNQLYNELNLGRREEYDVLDKRRGRDPEMGGKPRRKNPQEGLENELQKDKMAEAFSEIGMKGERRRGK

GHDGLFQGLSTATKDTFDALHMQALPPR** mu25E6-CAR T-8-28-3z-1XX (SEQ ID NO: 1614)
atggccttaccagtgaccgccttgctcctgccgctggccttgctgctccacgccgccaggccggaggtgcagctggt gggagtctggggggagacttagtgaagcctggagggtccctgaaactctcctgtgcagcctctggtttcactttcagta gttatggaatgtcttgggttcgccagactccagacaagaggctggagtgggtcgcaaccattagtaatggtggtaga cacaccttctatccagacagtgtgaaggggcgattcaccatctccagagacaatgccaagaacaccctgtatctgca aatgagcagtctgaagtctgaggacacagccatgtatttatgtgtaagacagactgggacggagggctggtttgctt actggggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaacccctgcccccagacctcctaccccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgccccaccacgcgacttcgcagcctatcgctccagagtgaagttcagcaggagcgca gacgcccccgcgtacaagcagggccagaaccagctctataacgagctcaatctaggacgaagagaggagtacgatgt tttggacaagagacgtggccgggaccctgagatggggggaaagccgagaaggaagaaccctcaggaaggcctgttca atgaactgcagaaagataagatggcggaggccttcagtgagattgggatgaaaggcgagcgccggaggggcaagggg cacgatggccttttccagggtctcagtacagccaccaaggacaccttcgacgcccttcacatgcaggccctgcccccc tcgctgataa (amino acids)

(SEQ ID NO: 1615)
MALPVTALLLPLALLLHAARPEVQLVESGGDLVKPGGSLKLSCAASGFTESSYGMSWVRQTPDKRLEWVATISNGGR

HTFYPDSVKGRFTISRDNAKNTLYLQMSSLKSEDTAMYLCVRQTGTEGWFAYWGQGTLVTVSAGGGGSGGGGSGGGG

SDVVMTQTPLTLSVTIGQPASISCKSSQSLLDSDGKTYLNWLLQRPGQSPKRLIYLVSKLDSGVPDRFTGSGSGTDF

TLKISRVEAEDLGVYYCWQGTHFPQTEGGGTKLEIKTTTPAPRPPTPAPTIASQPLSLRPEACRPAAGGAVHTRGLD

-continued

FACDIYIWAPLAGTCGVLLLSLVITLYCRSKRSRLLHSDYMNMTPRRPGPTRKHYQPYAPPRDFAAYRSRVKFSRSA

DAPAYKQGQNQLYNELNLGRREEYDVLDKRRGRDPEMGGKPRRKNPQEGLENELQKDKMAEAFSEIGMKGERRRGKG

HDGLFQGLSTATKDTFDALHMQALPPR** hu25E6-CAR T-8-28-3z-1XX (SEQ ID NO: 1616)

atggccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actggggccagggcaccctggtgaccgtgtccagcggcggtggcggaagcggaggcggtggctccggtggcggaggc agcgacatcgtgatgacccagacccctctgtctctgagcgtgacccctggccagcctgccagcatctcttgtaaaag cagcagagcctgctggacagcgacggcaagacctacctgaactggtacctgcagaagcccggccaaagcccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaaccccctgcccccagacctcctaccccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgcccaccacgcgacttcgcagcctatcgctccagagtgaagttcagcaggagcgca gacgcccccgcgtacaagcagggccagaaccagctctataacgagctcaatctaggacgaagagaggagtacgatgt tttggacaagagacgtggccgggaccctgagatggggggaaagccgagaaggaagaaccctcaggaaggcctgttca atgaactgcagaaagataagatggcgggaggccttcagtgagattgggatgaaaggcgagcgccggaggggcaagggg cacgatggcctttttccagggtctcagtacagccaccaaggacaccttcgacgcccttcacatgcaggccctgcccccc tcgctgataa (amino acids)

(SEQ ID NO: 1617)

MALPVTALLLPLALLLHAARPEVQLVESGGGLVKPGGSLRLSCAASGFTESSYGMSWVRQAPGKGLEWVSTISNGGR

HTFYPDSVKGRFTISRDNAKNSLYLQMNSLRAEDTAVYYCARQTGTEGWFAYWGQGTLVTVSSGGGGSGGGGSGGGG

SDIVMTQTPLSLSVTPGQPASISCKSSQSLLDSDGKTYLNWYLQKPGQSPQLLIYLVSKLDSGVPDRFSGSGSGTDF

TLKISRVEAEDVGVYYCWQGTHFPQTFGQGTKVEIKTTTPAPRPPTPAPTIASQPLSLRPEACRPAAGGAVHTRGLD

FACDIYIWAPLAGTCGVLLLSLVITLYCRSKRSRLLHSDYMNMTPRRPGPTRKHYQPYAPPRDFAAYRSRVKFSRSA

DAPAYKQGQNQLYNELNLGRREEYDVLDKRRGRDPEMGGKPRRKNPQEGLENELQKDKMAEAFSEIGMKGERRRGKG

HDGLFQGLSTATKDTFDALHMQALPPR**

MNC2-1XX
muMNC2-CAR T-8-4-1BB-3z-1XX (SEQ ID NO: 1618)

atggccttaccagtgaccgccttgctcctgccgctggccttgctgctccacgccgccaggccggaggtccagctgga ggagtcaggggggaggcttagtgaagcctggagggtccctgaaactctcctgtgcagcctctggattcacttttcagtg gctatgccatgtcttgggttcgccagactccggagaagaggctggagtgggtcgcaaccattagtagtggtggtact tatatctactatccagacagtgtgaaggggcgattcaccatctccagagacaatgccaagaacaccctgtacctgca aatgagcagtctgaggtctgaggacacggccatgtattactgtgcaagacttgggggggataattactacgaatact tcgatgtctggggcgcagggaccacggtcaccgtctcctccgccaaaacgacacccccatctgtctatggcggtggc ggatccggcggtggcggatccggcggtggcggatccgacattgtgatcacacagtctacagcttccttaggtgtatc -continued

```
tctggggcagagggccaccatctcatgcagggccagcaaaagtgtcagtacatctggctatagttatatgcactggt accaacagagaccaggacagccacccaaactcctcatctatcttgcatccaacctagaatctggggtccctgccagg ttcagtggcagtgggtctgggacagacttcaccctcaacatccatcctgtggaggaggaggatgctgcaacctatta ctgtcagcacagtagggagcttccgttcacgttcggaggggggaccaagctggagataaaacgggctgatgctgcac caactgtatccacaacaacccctgcccccagacctcctaccccagcccctacaattgccagccagcctctgagcctg aggcccgaggcttgtagacctgctgctggcggagccgtgcacaccagaggactggatttcgcctgcgacatctacat ctgggcgcccttggccgggacttgtggggtccttctcctgtcactggttatcaccctttactgcaaacggggcagaa agaaactcctgtatatattcaaacaaccatttatgagaccagtacaaactactcaagaggaagatggctgtagctgc cgatttccagaagaagaagaaggaggatgtgaactgagagtgaagttcagcaggagcgcagacgcccccgcgtacaa gcagggccagaaccagctctataacgagctcaatctaggacgaagagaggagtacgatgtttttggacaagagacgtg gccgggaccctgagatggggggaaagccgagaaggaagaaccctcaggaaggcctgttcaatgaactgcagaaagat aagatggcggaggccttcagtgagattgggatgaaaggcgagcgccggaggggcaaggggcacgatggcctttttcca gggtctcagtacagccaccaaggacaccttcgacgcccttcacatgcaggccctgcccctcgctgataa
```

(amino acids)
                                                       (SEQ ID NO: 1619)

```
MALPVTALLLPLALLLHAARPEVQLEESGGGLVKPGGSLKLSCAASGFTFSGYAMSWVRQTPEKRLEWVATISSGGT

YIYYPDSVKGRFTISRDNAKNTLYLQMSSLRSEDTAMYYCARLGGDNYYEYFDVWGAGTTVTVSSAKTTPPSVYGGG

GSGGGGSGGGGSDIVITQSTASLGVSLGQRATISCRASKSVSTSGYSYMHWYQQRPGQPPKLLIYLASNLESGVPAR

FSGSGSGTDFTLNIHPVEEEDAATYYCQHSRELPFTFGGGTKLEIKRADAAPTVSTTTPAPRPPTPAPTIASQPLSL

RPEACRPAAGGAVHTRGLDFACDIYIWAPLAGTCGVLLLSLVITLYCKRGRKKLLYIFKQPFMRPVQTTQEEDGCSC

REPEEEEGGCELRVKFSRSADAPAYKQGQNQLYNELNLGRREEYDVLDKRRGRDPEMGGKPRRKNPQEGLENELQKD

KMAEAFSEIGMKGERRRGKGHDGLFQGLSTATKDTFDALHMQALPPR**
``` huMNC2-CAR T-8-4-1BB-3z-1XX
                                                       (SEQ ID NO: 1620)

```
atggcccttaccagtgaccgccttgctcctgccgctggccttgctgctccacgccgccaggccggaggtgcagctggt ggagtctggggaggcctggtcaagcctggggggtccctgagactctcctgtgcagcctctggattcaccttcagtg gctatgccatgagctgggtccgccaggctccaggaagggggctggagtgggtctcaaccattagtagtggcggaacc tacatatactaccccgactcagtgaagggccgattcaccatctccagagacaacgccaagaactcactgtatctgca aatgaacagcctgagagccgaggcacggccgtgtattactgtgcgagacttggggggggataattactacgaatact tcgatgtctggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcggagggaccaaggtggagatcaaacgaactacaacaacccctgccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcacccttactgcaaacggggcagaaagaaactcctgtatatattcaaacaaccatttatgagaccagtacaaa ctactcaagaggaagatggctgtagctgccgatttccagaagaagaagaaggaggatgtgaactgagagtgaagttc agcaggagcgcagacgcccccgcgtacaagcagggccagaaccagctctataacgagctcaatctaggacgaagaga ggagtacgatgtttttggacaagagacgtggccgggaccctgagatggggggaaagccgagaaggaagaaccctcagg aaggcctgttcaatgaactgcagaaagataagatggcggaggccttcagtgagattgggatgaaaggcgagcgccgg
```

-continued aggggcaaggggcacgatggcctttccagggtctcagtacagccaccaaggacaccttcgacgcccttcacatgca ggccctgcccctcgctgataa (amino acids)

(SEQ ID NO: 1621)
MALPVTALLLPLALLLHAARPEVQLVESGGGLVKPGGSLRLSCAASGFTFSGYAMSWVRQAPGKGLEWVSTISSGGT

YIYYPDSVKGRFTISRDNAKNSLYLQMNSLRAEDTAVYYCARLGGDNYYEYFDVWGKGTTVTVSSGGGGSGGGGSGG

GGSDIVLTQSPASLAVSPGQRATITCRASKSVSTSGYSYMHWYQQKPGQPPKLLIYLASNLESGVPARFSGSGSGTD

FTLTINPVEANDTANYYCQHSRELPFTEGGGTKVEIKRTTTTPAPRPPTPAPTIASQPLSLRPEACRPAAGGAVHTR

GLDFACDIYIWAPLAGTCGVLLLSLVITLYCKRGRKKLLYIFKQPFMRPVQTTQEEDGCSCRFPEEEEGGCELRVKF

SRSADAPAYKQGQNQLYNELNLGRREEYDVLDKRRGRDPEMGGKPRRKNPQEGLENELQKDKMAEAFSEIGMKGERR

RGKGHDGLFQGLSTATKDTFDALHMQALPPR** muMNC2-CAR T-8-28-3z-1XX (SEQ ID NO: 1622)
atggccttaccagtgaccgccttgctcctgccgctggccttgctgctccacgccgccaggccggaggtccagctgga ggagtcaggggggaggcttagtgaagcctggagggtccctgaaactctcctgtgcagcctctggattcactttcagtg gctatgccatgtcttgggttcgccagactccggagaagaggctggagtgggtcgcaaccattagtagtggtggtact tatatctactatccagacagtgtgaaggggcgattcaccatctccagagacaatgccaagaacaccctgtacctgca aatgagcagtctgaggtctgaggacacggccatgtattactgtgcaagacttggggggggataattactacgaatact tcgatgtctggggcgcagggaccacggtcaccgtctcctccgccaaaacgacacccccatctgtctatggcggtggc ggatccggcggtggcggatccggcggtggcggatccgacattgtgatcacacagtctacagcttccttaggtgtatc tctggggcagagggccaccatctcatgcagggccagcaaaagtgtcagtacatctggctatagttatatgcactggt accaacagagaccaggacagccacccaaactcctcatctatcttgcatccaacctagaatctggggtccctgccagg ttcagtggcagtgggtctgggacagacttcaccctcaacatccatcctgtggaggaggaggatgctgcaacctatta ctgtcagcacagtagggagcttccgttcacgttcggaggggggaccaagctggagataaaacgggctgatgctgcac caactgtatccacaacaacccctgcccccagacctcctaccccagccctacaattgccagccagcctctgagcctg aggcccgaggcttgtagacctgctgctggcggagccgtgcacaccagaggactggatttcgcctgcgacatctacat ctgggcgcccttggccgggacttgtggggtccttctcctgtcactggttatcacccttactgcaggagtaagagga gcaggctcctgcacagtgactacatgaacatgactcctagaagacctgggcctaccagaaagcattaccagccctat gccccaccacgcgacttcgcagcctatcgctccagagtgaagttcagcaggagcgcagacgcccccgcgtacaagca gggccagaaccagctctataacgagctcaatctaggacgaagagaggagtacgatgtgtttggacaagagacgtggcc gggaccctgagatggggggaaagccgagaaggaagaaccctcaggaaggcctgttcaatgaactgcagaaagataag atggcggaggccttcagtgagattgggatgaaaggcgagcgccggaggggcaaggggcacgatggcctttttccaggg tctcagtacagccaccaaggacaccttcgacgcccttcacatgcaggccctgcccctcgctgataa (amino acids)

(SEQ ID NO: 1623)
MALPVTALLLPLALLLHAARPEVQLEESGGGLVKPGGSLKLSCAASGFTFSGYAMSWVRQTPEKRLEWVATISSGGT

YIYYPDSVKGRFTISRDNAKNTLYLQMSSLRSEDTAMYYCARLGGDNYYEYFDVWGAGTTVTVSSAKTTPPSVYGGG

GSGGGGSGGGGSDIVITQSTASLGVSLGQRATISCRASKSVSTSGYSYMHWYQQRPGQPPKLLIYLASNLESGVPAR

FSGSGSGTDFTLNIHPVEEEDAATYYCQHSRELPFTFGGGTKLEIKRADAAPTVSTTTPAPRPPTPAPTIASQPLSL

RPEACRPAAGGAVHTRGLDFACDIYIWAPLAGTCGVLLLSLVITLYCRSKRSRLLHSDYMNMTPRRPGPTRKHYQPY

APPRDFAAYRSRVKFSRSADAPAYKQGQNQLYNELNLGRREEYDVLDKRRGRDPEMGGKPRRKNPQEGLFNELQKDK

MAEAFSEIGMKGERRRGKGHDGLFQGLSTATKDTFDALHMQALPPR** huMNC2-CAR T-8-28-3z-1XX (SEQ ID NO: 1624)
atggccttaccagtgaccgccttgctcctgccgctggccttgctgctccacgccgccaggccggaggtgcagctggt ggagtctgggggaggcctggtcaagcctggggggtccctgagactctcctgtgcagcctctggattcaccttcagtg gctatgccatgagctgggtccgccaggctccaggaaggggctggagtgggtctcaaccattagtagtggcggaacc tacatatactaccccgactcagtgaagggccgattcaccatctccagagacaacgccaagaactcactgtatctgca aatgaacagcctgagagccgaggacacggccgtgtattactgtgcgagacttggggggggataattactacgaatact tcgatgtctggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcgcgagggaccaaggtggagatcaaacgaactacaacaacccctgccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcaccctttactgcaggagtaagaggagcaggctcctgcacagtgactacatgaacatgactcctagaagacctg ggcctaccagaaagcattaccagccctatgccccaccacgcgacttcgcagcctatcgctccagagtgaagttcagc aggagcgcagacgcccccgcgtacaagcagggccagaaccagctctataacgagctcaatctaggacgaagagagga gtacgatgtttttggacaagagacgtggccgggaccctgagatggggggaaagccgagaaggaagaaccctcaggaag gcctgttcaatgaactgcagaaagataagatggcggaggccttcagtgagattgggatgaaaggcgagcgccggagg ggcaaggggcacgatggcctttttccagggtctcagtacagccaccaaggacaccttcgacgcccttcacatgcaggc cctgcccctcgctgataa (amino acids)

(SEQ ID NO: 1625)
MALPVTALLLPLALLLHAARPEVQLVESGGGLVKPGGSLRLSCAASGFTFSGYAMSWVRQAPGKGLEWVSTISSGGT

YIYYPDSVKGRFTISRDNAKNSLYLQMNSLRAEDTAVYYCARLGGDNYYEYFDVWGKGTTVTVSSGGGGSGGGGSGG

GGSDIVLTQSPASLAVSPGQRATITCRASKSVSTSGYSYMHWYQQKPGQPPKLLIYLASNLESGVPARFSGSGSGTD

FTLTINPVEANDTANYYCQHSRELPFTEGGGTKVEIKRTTTTPAPRPPTPAPTIASQPLSLRPEACRPAAGGAVHTR

GLDFACDIYIWAPLAGTCGVLLLSLVITLYCRSKRSRLLHSDYMNMTPRRPGPTRKHYQPYAPPRDFAAYRSRVKFS

RSADAPAYKQGQNQLYNELNLGRREEYDVLDKRRGRDPEMGGKPRRKNPQEGLENELQKDKMAEAFSEIGMKGERRR

GKGHDGLFQGLSTATKDTFDALHMQALPPR**

MNE6-1XX
muMNE6-CAR T-8-4-1BB-3z-1XX (SEQ ID NO: 1626)
atggccttaccagtgaccgccttgctcctgccgctggccttgctgctccacgccgccaggccggaggtgaaggtggt ggagtctgggggagacttagtgaagcctggagggtccctgaaactctcctgtgtagtctctggattcactttcagta gatatggcatgtcttgggttcgccagactccaggcaagaggctggagtgggtcgcaaccattagtggtggcggtact tacatctactatccagacagtgtgaagggccgattcaccatctccagagacaatgccaagaacaccctgtacctgca aatgagcagtctgaagtctgaggacacagccatgtatcactgtacaagggataactacggtaggaactacgactacg gtatggactactggggtcaaggaacctcagtcaccgtctcctcaggcggtggcggatccggcggtggcggatccggc ggtggcggatcccaaattgttctcacccagtctccagcaatcatgtctgcatctccaggggaggaggtcaccctaac ctgcagtgccacctcaagtgtaagttacatacactggttccagcagaggccaggcacttctcccaaactctggattt atagcacatccaacctggcttctggagtccctgttcgcttcagtggcagtggatatgggacctcttactctctcaca atcagccgaatggaggctgaagatgctgccacttattactgccagcaaaggagtagttccccattcacgttcggctc -continued

```
ggggacaaagttggaaataaaaacaacaacccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcaa acggggcagaaagaaactcctgtatatattcaaacaaccatttatgagaccagtacaaactactcaagaggaagatg gctgtagctgccgatttccagaagaagaagaaggaggatgtgaactgagagtgaagttcagcaggagcgcagacgcc cccgcgtacaagcagggccagaaccagctctataacgagctcaatctaggacgaagagaggagtacgatgtttttgga caagagacgtggccgggaccctgagatgggggggaaagccgagaaggaagaaccctcaggaaggcctgttcaatgaac tgcagaaagataagatggcggaggccttcagtgagattgggatgaaaggcgagcgccggaggggcaaggggcacgat ggcctttttccagggtctcagtacagccaccaaggacaccttcgacgcccttcacatgcaggccctgccccctcgctg ataa (amino acids)
                                                                    (SEQ ID NO: 1627)
MALPVTALLLPLALLLHAARPEVKVVESGGGDLVKPGGSLKLSCVVSGFTESRYGMSWVRQTPGKRLEWVATISGGGT

YIYYPDSVKGRFTISRDNAKNTLYLQMSSLKSEDTAMYHCTRDNYGRNYDYGMDYWGQGTSVTVSSGGGGSGGGGSG

GGGSQIVLTQSPAIMSASPGEEVTLTCSATSSVSYIHWFQQRPGTSPKLWIYSTSNLASGVPVRFSGSGYGTSYSLT

ISRMEAEDAATYYCQQRSSSPFTEGSGTKLEIKTTTPAPRPPTPAPTIASQPLSLRPEACRPAAGGAVHTRGLDFAC

DIYIWAPLAGTCGVLLLSLVITLYCKRGRKKLLYIFKQPFMRPVQTTQEEDGCSCRFPEEEEGGCELRVKFSRSADA

PAYKQGQNQLYNELNLGRREEYDVLDKRRGRDPEMGGKPRRKNPQEGLENELQKDKMAEAFSEIGMKGERRRGKGHD

GLFQGLSTATKDTFDALHMQALPPR** huMNE6-CAR T-8-4-1BB-3z-1XX
                                                                    (SEQ ID NO: 1628)
atggcccttaccagtgaccgccttgctcctgccgctggccttgctgctccacgccgccaggccggaggtgcagctggt ggagtctgggggaggcctggtcaagcctggggggtccctgagactctcctgtgcagcctctggattcaccttcagta ggtatggcatgagctgggtccgccaggctccagggaagaggctggagtgggtctcaaccattagtggcggaggcacc tacatatactacccagactcagtgaagggccgattcaccatctccagagacaacgccaagaacaccctgtatctgca aatgaacagcctgagagccgaggacacggctgtgtattactgtaccagagataactatggccgcaactatgattatg gcatggattattggggccagggcaccctggtgaccgtgagcagcggcggtggcggatccggcggtggcggatccggc ggtggcggatccgaaattgtgttgacacagtctccagccaccctgtctttgtctccaggggaaagagccaccctcac ctgcagcgccaccagcagtgttagctacatccactggtaccaacagaggcctggccagagccccaggctcctcatct atagcacctccaacctggccagcggcatcccagccaggttcagtggcagtgggtctgggagcgactacactctcacc atcagcagcctagagcctgaagattttgcagtttattactgtcagcagcgtagcagctcccctttcaccttggcag cggcaccaaagtggaaattaaaacaacaacccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcaa acggggcagaaagaaactcctgtatatattcaaacaaccatttatgagaccagtacaaactactcaagaggaagatg gctgtagctgccgatttccagaagaagaagaaggaggatgtgaactgagagtgaagttcagcaggagcgcagacgcc cccgcgtacaagcagggccagaaccagctctataacgagctcaatctaggacgaagagaggagtacgatgtttttgga caagagacgtggccgggaccctgagatgggggggaaagccgagaaggaagaaccctcaggaaggcctgttcaatgaac tgcagaaagataagatggcggaggccttcagtgagattgggatgaaaggcgagcgccggaggggcaaggggcacgat ggcctttttccagggtctcagtacagccaccaaggacaccttcgacgcccttcacatgcaggccctgcccctcgctg ataa
```

-continued (amino acids)

(SEQ ID NO: 1629)

MALPVTALLLPLALLLHAARPEVQLVESGGGLVKPGGSLRLSCAASGFTESRYGMSWVRQAPGKRLEWVSTISGGGT

YIYYPDSVKGRFTISRDNAKNTLYLQMNSLRAEDTAVYYCTRDNYGRNYDYGMDYWGQGTLVTVSSGGGGSGGGGSG

GGGSEIVLTQSPATLSLSPGERATLTCSATSSVSYIHWYQQRPGQSPRLLIYSTSNLASGIPARFSGSGSGSDYTLT

ISSLEPEDFAVYYCQQRSSSPFTEGSGTKVEIKTTTPAPRPPTPAPTIASQPLSLRPEACRPAAGGAVHTRGLDFAC

DIYIWAPLAGTCGVLLLSLVITLYCKRGRKKLLYIFKQPFMRPVQTTQEEDGCSCRFPEEEEGGCELRVKFSRSADA

PAYKQGQNQLYNELNLGRREEYDVLDKRRGRDPEMGGKPRRKNPQEGLENELQKDKMAEAFSEIGMKGERRRGKGHD
GLFQGLSTATKDTFDALHMQALPPR\*\* muMNE6-CART-8-4-28-3z-1XX (SEQ ID NO: 1630)

atggccttaccagtgaccgccttgctcctgccgctggccttgctgctccacgccgccaggccggaggtgaaggtggt ggagtctggggggagacttagtgaagcctggagggtccctgaaactctcctgtgtagtctctggattcactttcagta gatatggcatgtcttgggttcgccagactccaggcaagaggctggagtgggtcgcaaccattagtggtggcggtact tacatctactatccagacagtgtgaaggggcgattcaccatctccagagacaatgccaagaacaccctgtacctgca aatgagcagtctgaagtctgaggacacagccatgtatcactgtacaagggataactacggtaggaactacgactacg gtatggactactggggtcaaggaacctcagtcaccgtctcctcaggcggtggcggatccggcggtggcggatccggc ggtggcggatcccaaattgttctcacccagtctccagcaatcatgtctgcatctccaggggaggaggtcaccctaac ctgcagtgccacctcaagtgtaagttacatacactggttccagcagaggccaggcacttctcccaaactctggattt atagcacatccaacctggcttctggagtccctgttcgcttcagtggcagtggatatgggacctcttactctctcaca atcagccgaatggaggctgaagatgctgccacttattactgccagcaaaggagtagttccccattcacgttcggctc ggggacaaagttggaaataaaaacaacaacccctgcccccagacctcctaccccagccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcaccctttactgcag gagtaagaggagcaggctcctgcacagtgactacatgaacatgactcctagaagacctgggcctaccagaaagcatt accagccctatgcccccaccacgcgacttcgcagcctatcgctccagagtgaagttcagcaggagcgcagacgcccc gcgtacaagcagggccagaaccagctctataacgagctcaatctaggacgaagagaggagtacgatgtttttggacaa gagacgtggccgggaccctgagatggggggaaagccgagaaggaagaaccctcaggaaggcctgttcaatgaactgc agaaagataagatggcggaggcttcagtgagattgggatgaaaggcgagcgccggaggggcaaggggcacgatggc cttttccagggtctcagtacagccaccaaggacaccttcgacgcccttcacatgcaggccctgccccctcgctgata a (amino acids)

(SEQ ID NO: 1631)

MALPVTALLLPLALLLHAARPEVKVVESGGDLVKPGGSLKLSCVVSGFTESRYGMSWVRQTPGKRLEWVATISGGGT

YIYYPDSVKGRFTISRDNAKNTLYLQMSSLKSEDTAMYHCTRDNYGRNYDYGMDYWGQGTSVTVSSGGGGSGGGGSG

GGGSQIVLTQSPAIMSASPGEEVTLTCSATSSVSYIHWFQQRPGTSPKLWIYSTSNLASGVPVRFSGSGYGTSYSLT

ISRMEAEDAATYYCQQRSSSPFTEGSGTKLEIKTTTPAPRPPTPAPTIASQPLSLRPEACRPAAGGAVHTRGLDFAC

DIYIWAPLAGTCGVLLLSLVITLYCRSKRSRLLHSDYMNMTPRRPGPTRKHYQPYAPPRDFAAYRSRVKFSRSADAP

AYKQGQNQLYNELNLGRREEYDVLDKRRGRDPEMGGKPRRKNPQEGLENELQKDKMAEAFSEIGMKGERRRGKGHDG

LFQGLSTATKDTFDALHMQALPPR\*\* huMNE6-CAR T-8-4-28-3z-1XX (SEQ ID NO: 1632)

atggcctttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagta ggtatggcatgagctgggtccgccaggctccagggaagaggctggagtgggtctcaaccattagtggcggaggcacc -continued tacatatactacccagactcagtgaagggccgattcaccatctccagagacaacgccaagaacaccctgtatctgca aatgaacagcctgagagccgaggacacggctgtgtattactgtaccagagataactatggccgcaactatgattatg gcatggattattggggccagggcaccctggtgaccgtgagcagcggcggtggcggatccggcggtggcggatccggc ggtggcggatccgaaattgtgttgacacagtctccagccaccctgtctttgtctccaggggaaagagccaccctcac ctgcagcgccaccagcagtgttagctacatccactggtaccaacagaggcctggccagagccccaggctcctcatct atagcacctccaacctggccagcggcatcccagccaggttcagtggcagtgggtctgggagcgactacactctcacc atcagcagcctagagcctgaagattttgcagtttattactgtcagcagcgtagcagctcccctttcacctttggcag cggcaccaaagtggaaattaaaacaacaacccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcag gagtaagaggagcaggctcctgcacagtgactacatgaacatgactcctagaagacctgggcctaccagaaagcatt accagccctatgcccaccacgcgacttcgcagcctatcgctccagagtgaagttcagcaggagcgcagacgcccccc gcgtacaagcagggccagaaccagctctataacgagctcaatctaggacgaagagaggagtacgatgtttttggacaa gagacgtggccgggaccctgagatgggggggaaagccgagaaggaagaaccctcaggaaggcctgttcaatgaactgc agaaagataagatggcggaggccttcagtgagattgggatgaaaggcgagcgccggagggggcaagggggcacgatggc cttttccagggtctcagtacagccaccaaggacaccttcgacgcccttcacatgcaggccctgcccctcgctgata a (amino acids)

(SEQ ID NO: 1633)

MALPVTALLLPLALLLHAARPEVQLVESGGGLVKPGGSLRLSCAASGFTESRYGMSWVRQAPGKRLEWVSTISGGGT

YIYYPDSVKGRFTISRDNAKNTLYLQMNSLRAEDTAVYYCTRDNYGRNYDYGMDYWGQGTLVTVSSGGGGSGGGGSG

GGGSEIVLTQSPATLSLSPGERATLTCSATSSVSYIHWYQQRPGQSPRLLIYSTSNLASGIPARFSGSGSGSDYTLT

ISSLEPEDFAVYYCQQRSSSPFTEGSGTKVEIKTTTPAPRPPTPAPTIASQPLSLRPEACRPAAGGAVHTRGLDFAC

DIYIWAPLAGTCGVLLLSLVITLYCRSKRSRLLHSDYMNMTPRRPGPTRKHYQPYAPPRDFAAYRSRVKFSRSADAP

AYKQGQNQLYNELNLGRREEYDVLDKRRGRDPEMGGKPRRKNPQEGLENELQKDKMAEAFSEIGMKGERRRGKGHDG
LFQGLSTATKDTFDALHMQALPPR**

Minimal CMV promoter (mCMV)
(DNA)
(SEQ ID NO: 1634)
taggcgtgtacggtgggaggcctatataagcagagctcgtttagtgaaccgtcagatcgcctggagacgccatccac gctgttttgacctccatagaagacaccgggaccgatccag Minimal IL2 promoter (mIL2P)
(SEQ ID NO: 1635)
cattttgacacccccataatatttttccagaattaacagtataaattgcatctcttgttcaagagttccctatcact ctctttaatcactactcacagtaacctcaactcctgc Minimal promoter, miniP
(DNA)
(SEQ ID NO: 1636)
Agagggtatataatggaagctcgacttccag IL-18 activated
(DNA)
(SEQ ID NO: 1637)
atggccttaccagtgaccgccttgctcctgccgctggccttgctgctccacgccgccaggccgtacttcggcaagct ggaaagcaagctgagcgtgatccggaacctgaacgaccaggtgctgttcatcgatcagggcaacagacccctgttcg aggacatgaccgacagcgactgcagagacaacgcccctcggaccatcttcatcatcagcatgtacaaggacagccag cctagaggcatggccgtgaccatctctgtgaagtgcgagaagatcagcacccctgagctgcgagaacaagatcatcag -continued

```
cttcaaagagatgaacccgccggacaacatcaaggacaccaagagcgacatcatattcttccagcggagcgtgcccg gccacgacaacaagatgcagtttgagagcagcagctacgagggctacttcctggcctgcgagaaagagcgggacctg ttcaagctgatcctgaagaaagaggacgaactgggcgaccgcagcatcatgttcaccgtgcagaacgaggactgata a
```

(amino acids)

(SEQ ID NO: 1638)

```
MALPVTALLLPLALLLHAARPYFGKLESKLSVIRMLNDQVLFIDQGNRPLFEDMTDSDCR

DNAPRTIFIISMYKDSQPRGMAVTISVKCEKISTLSCENKIISFKEMNPPDNIKDTKSDI

IFFQRSVPGHDNKMQFESSSYEGYFLACEKERDLFKLILKKEDELGDRSIMFTVQNED**
```

Foxp3-NFATc1-X3-IL-18
(DNA)

(SEQ ID NO: 1639)

```
ggcttcattttttccatttactgcagaggcttcattttttccatttactgcagaggcttcattttttccatttactg cagaactagttaggcgtgtacggtgggaggcctatataagcagagctcgtttagtgaaccgtcagatcgcctggaga cgccatccacgctgtttttgacctccatagaagacaccgggaccgatccagcctcgagagacccaatgctagccacca tggccttaccagtgaccgccttgctcctgccgctggccttgctgctccacgccgccaggccgtacttcggcaagctg gaaagcaagctgagcgtgatccggaacctgaacgaccaggtgctgttcatcgatcagggcaacagacccctgttcga ggacatgaccgacagcgactgcagagacaacgcccctcggaccatcttcatcatcagcatgtacaaggacagccagc ctagaggcatggccgtgaccatctctgtgaagtgcgagaagatcagcaccctgagctgcgagaacaagatcatcagc ttcaaagagatgaacccgccggacaacatcaaggacaccaagagcgacatcatattcttccagcggagcgtgcccgg ccacgacaacaagatgcagtttgagagcagcagctacgagggctacttcctggcctgcgagaaagagcgggacctgt tcaagctgatcctgaagaaagaggacgaactgggcgaccgcagcatcatgttcaccgtgcagaacgaggactgataa
```

Foxp3-NFATc1-X6-IL-18
(DNA)

(SEQ ID NO: 1640)

```
gcttcattttttccatttactgcagaggcttcattttttccatttactgcagaggcttcattttttccatttactgc agaggcttcattttttccatttactgcagaggcttcattttttccatttactgcagaggcttcattttttccattta ctgcagaactagttaggcgtgtacggtgggaggcctatataagcagagctcgtttagtgaaccgtcagatcgcctgg agacgccatccacgctgtttttgacctccatagaagacaccgggaccgatccagcctcgagagacccaatgctagcca ccatggccttaccagtgaccgccttgctcctgccgctggccttgctgctccacgccgccaggccgtacttcggcaag ctggaaagcaagctgagcgtgatccggaacctgaacgaccaggtgctgttcatcgatcagggcaacagacccctgtt cgaggacatgaccgacagcgactgcagagacaacgcccctcggaccatcttcatcatcagcatgtacaaggacagcc agcctagaggcatggccgtgaccatctctgtgaagtgcgagaagatcagcaccctgagctgcgagaacaagatcatc agcttcaaagagatgaacccgccggacaacatcaaggacaccaagagcgacatcatattcttccagcggagcgtgcc cggccacgacaacaagatgcagtttgagagcagcagctacgagggctacttcctggcctgcgagaaagagcgggacc tgttcaagctgatcctgaagaaagaggacgaactgggcgaccgcagcatcatgttcaccgtgcagaacgaggactga taa
```

IL-2-NFATc1-X3-IL-18
(DNA)

(SEQ ID NO: 1641)

```
ggaggaaaaactgtttcatacagaaggcgtggaggaaaaactgtttcatacagaaggcgtggaggaaaaactgtttc atacagaaggcgtactagttaggcgtgtacggtgggaggcctatataagcagagctcgtttagtgaaccgtcagatc gcctggagacgccatccacgctgtttttgacctccatagaagacaccgggaccgatccagcctcgagagacccaatgc tagccaccatggccttaccagtgaccgccttgctcctgccgctggccttgctgctccacgccgccaggccgtacttc ggcaagctggaaagcaagctgagcgtgatccggaacctgaacgaccaggtgctgttcatcgatcagggcaacagacc cctgttcgaggacatgaccgacagcgactgcagagacaacgcccctcggaccatcttcatcatcagcatgtacaagg
``` acagccagcctagaggcatggccgtgaccatctctgtgaagtgcgagaagatcagcaccctgagctgcgagaacaag atcatcagcttcaaagagatgaacccgccggacaacatcaaggacaccaagagcgacatcatattcttccagcggag cgtgcccggccacgacaacaagatgcagtttgagagcagcagctacgagggctacttcctggcctgcgagaaagagc gggacctgttcaagctgatcctgaagaaagaggacgaactgggcgaccgcagcatcatgttcaccgtgcagaacgag gactgataa IL-2-NFATc1-X6-IL-18
(DNA)
                                                                                (SEQ ID NO: 1642)
ggaggaaaaactgtttcatacagaaggcgtggaggaaaaactgtttcatacagaaggcgtggaggaaaaactgtttc atacagaaggcgtggaggaaaaactgtttcatacagaaggcgtggaggaaaaactgtttcatacagaaggcgtggag gaaaaactgtttcatacagaaggcgtactagttaggcgtgtacggtgggaggcctatataagcagagctcgtttagt gaaccgtcagatcgcctggagacgccatccacgctgttttgacctccatagaagacaccgggaccgatccagctcga gagacccaatgctagccaccatggccttaccagtgaccgccttgctcctgccgctggccttgctgctccacgccgcc aggccgtacttcggcaagctggaaagcaagctgagcgtgatccggaacctgaacgaccaggtgctgttcatcgatca gggcaacagacccctgttcgaggacatgaccgacagcgactgcagagacaacgcccctcggaccatcttcatcatca gcatgtacaaggacagccagcctagaggcatggccgtgaccatctctgtgaagtgcgagaagatcagcaccctgagc tgcgagaacaagatcatcagcttcaaagagatgaacccgccggacaacatcaaggacaccaagagcgacatcatatt cttccagcggagcgtgcccggccacgacaacaagatgcagtttgagagcagcagctacgagggctacttcctggcct gcgagaaagagcgggacctgttcaagctgatcctgaagaaagaggacgaactgggcgaccgcagcatcatgttcacc gtgcagaacgaggactgataa Best antibodies with inducible IL-18 +/- 1XX mutations in ITAMs of CD3-zeta
MNC2
muMNC2-8-4-1BB-3z-Foxp3-NFAT-IL-18
(DNA)
                                                                                (SEQ ID NO: 1643)
atggccttaccagtgaccgccttgctcctgccgctggccttgctgctccacgccgccaggccggaggtccagctgga ggagtcaggggggaggcttagtgaagcctggagggtccctgaaactctcctgtgcagcctctggattcactttcagtg gctatgccatgtcttgggttcgccagactccggagaagaggctggagtgggtcgcaaccattagtagtggtggtact tatatctactatccagacagtgtgaaggggcgattcaccatctccagagacaatgccaagaacaccctgtacctgca aatgagcagtctgaggtctgaggacacggccatgtattactgtgcaagacttggggggggataattactacgaatact tcgatgtctggggcgcaggggaccacggtcaccgtctcctccgccaaaacgacacccccatctgtctatggcggtggc ggatccggcggtggcggatccggcggtggcggatccgacattgtgatcacacagtctacagcttccttaggtgtatc tctggggcagagggccaccatctcatgcagggccagcaaaagtgtcagtacatctggctatagttatatgcactggt accaacagagaccaggacagccacccaaactcctcatctatcttgcatccaacctagaatctggggtccctgccagg ttcagtggcagtgggtctgggacagacttcacccctcaacatccatcctgtggaggaggaggatgctgcaacctatta ctgtcagcacagtagggagcttccgttcacgttcggaggggggaccaagctggagataaaacgggctgatgctgcac caactgtatccacaacaaccctgccccagacctcctaccccagccctacaattgccagccagcctctgagcctg aggcccgaggcttgtagacctgctgctggcggagccgtgcacaccagaggactggatttcgcctgcgacatctacat ctgggcgcccttggccgggacttgtggggtccttctcctgtcactggttatcaccctttactgcaaacggggcagaa agaaactcctgtatatattcaaacaaccatttatgagaccagtacaaactactcaagaggaagatggctgtagctgc cgatttccagaagaagaagaaggaggatgtgaactgagagtgaagttcagcaggagcgcagacgcccccgcgtacaa gcagggccagaaccagctctataacgagctcaatctaggacgaagagaggagtacgatgtttttggacaagagacgtg gccgggaccctgagatggggggaaagccgagaaggaagaaccctcaggaaggcctgtacaatgaactgcagaaagat aagatggcggaggcctacagtgagattgggatgaaaggcgagcgccggagggggcaaggggcacgatggcctttacca gggtctcagtacagccaccaaggacacctacgacgcccttcacatgcaggccctgcccctcgctgataagtttaaa ctgccagaacatttctctggcctaactggccggtaccggcttcattttttccatttactgcagaggcttcatttttt ccatttactgcagaggcttcattttttccatttactgcagaactagttaggcgtgtacggtgggaggcctatataag cagagctcgtttagtgaaccgtcagatcgcctggagacgccatccacgctgttttgacctccatagaagacaccggg accgatccagcctcgagagacccaatgctagccaccatggccttaccagtgaccgccttgctcctgccgctggcctt gctgctccacgccgccaggccgtacttcggcaagctggaaagcaagctgagcgtgatccggaacctgaacgaccagg tgctgttcatcgatcagggcaacagacccctgttcgaggacatgaccgacagcgactgcagagacaacgcccctcgg accatcttcatcatcagcatgtacaaggacagccagcctagaggcatggccgtgaccatctctgtgaagtgcgagaa gatcagcaccctgagctgcgagaacaagatcatcagcttcaaagagatgaacccgccggacaacatcaaggacacca agagcgacatcatattcttccagcggagcgtgcccggccacgacaacaagatgcagtttgagagcagcagctacgag ggctacttcctggcctgcgagaaagagcgggacctgttcaagctgatcctgaagaaagaggacgaactgggcgaccg cagcatcatgttcaccgtgcagaacgaggactgataa huMNC2-8-4-1BB-3z-Foxp3-NFAT-IL-18
(DNA)

(SEQ ID NO: 1644)

atggcccttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagtg gctatgccatgagctgggtccgccaggctccagggaaggggctggagtgggtctcaaccattagtagtggcggaacc tacatatactaccccgactcagtgaagggccgattcaccatctccagagacaacgccaagaactcactgtatctgca aatgaacagcctgagagccgaggacacggccgtgtattactgtgcgagacttggggggggataattactacgaatact tcgatgtctggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcggagggaccaaggtggagatcaaacgaactacaacaaccccctgcccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcacccttttactgcaaacggggcagaaagaaactcctgtatatattcaaacaaccatttatgagaccagtacaaa ctactcaagaggaagatggctgtagctgccgatttccagaagaagaagaaggaggatgtgaactgagagtgaagttc agcaggagcgcagacgcccccgcgtacaagcagggccagaaccagctctataacgagctcaatctaggacgaagaga ggagtacgatgtttttggacaagagacgtggccgggaccctgagatggggggaaagccgagaaggaagaaccctcagg aaggcctgtacaatgaactgcagaaagataagatggcggaggcctacagtgagattgggatgaaaggcgagcgccgg aggggcaaggggcacgatggcctttaccagggtctcagtacagccaccaaggacacctacgacgcccttcacatgca ggccctgccccctcgctgataagtttaaactgccagaacatttctctggcctaactggccggtaccggcttcatttt ttccatttactgcagaggcttcattttttccatttactgcagaggcttcattttttccatttactgcagaactagtt aggcgtgtacggtgggaggcctatataagcagagctcgtttagtgaaccgtcagatcgcctggagacgccatccacg ctgttttgacctccatagaagacaccgggaccgatccagcctcgagagacccaatgctagccaccatggccttacca gtgaccgccttgctcctgccgctggccttgctgctccacgccgccaggccgtacttcggcaagctggaaagcaagct gagcgtgatccggaacctgaacgaccaggtgctgttcatcgatcagggcaacagacccctgttcgaggacatgaccg acagcgactgcagagacaacgcccctcggaccatcttcatcatcagcatgtacaaggacagccagcctagaggcatg gccgtgaccatctctgtgaagtgcgagaagatcagcaccctgagctgcgagaacaagatcatcagcttcaaagagat -continued gaaccogocggacaacatcaaggacaccaagagcgacatcatattcttccagcggagcgtgcccggccacgacaaca agatgcagtttgagagcagcagotacgagggctacttcctggcctgcgagaaagagcgggacctgttcaagctgatc ctgaagaaagaggacgaactgggcgaccgcagcatcatgttcaccgtgcagaacgaggactgataa muMNC2-8-28-3z-Foxp3-NFAT-IL-18
(DNA)

(SEQ ID NO: 1645)

atggccttaccagtgaccgccttgctcctgccgctggccttgctgctccacgccgccaggccggaggtccagctgga ggagtcaggggggaggcttagtgaagcctggagggtccctgaaactctcctgtgcagcctctggattcactttcagtg gctatgccatgtcttgggttcgccagactccggagaagaggctggagtgggtcgcaaccattagtagtggtggtact tatatctactatccagacagtgtgaaggggcgattcaccatctccagagacaatgccaagaacaccctgtacctgca aatgagcagtctgaggtctgaggacacggccatgtattactgtgcaagacttggggggggataattactacgaatact tcgatgtctggggcgcagggaccacggtcaccgtctcctccgccaaaacgacacccccatctgtctatggcggtggc ggatccggcggtggcggatccggcggtggcggatccgacattgtgatcacacagtctacagcttccttaggtgtatc tctggggcagagggccaccatctcatgcagggccagcaaaagtgtcagtacatctggctatagttatatgcactggt accaacagagaccaggacagccacccaaactcctcatctatcttgcatccaacctagaatctggggtccctgccagg ttcagtggcagtgggtctgggacagacttcaccctcaacatccatcctgtggaggaggaggatgctgcaacctatta ctgtcagcacagtagggagcttccgttcacgttcggagggggaccaagctggagataaaacgggctgatgctgcac caactgtatccacaacaacccctgcccccagacctcctaccccagccctacaattgccagccagcctctgagcctg aggcccgaggcttgtagacctgctgctggcggagccgtgcacaccagaggactggatttcgcctgcgacatctacat ctgggcgcccttggccgggacttgtggggtccttctcctgtcactggttatcaccctttactgcaggagtaagagga gcaggctcctgcacagtgactacatgaacatgactcctagaagacctgggcctaccagaaagcattaccagccctat gccccaccacgcgacttcgcagcctatcgctccagagtgaagttcagcaggagcgcagacgcccccgcgtacaagca gggccagaaccagctctataacgagctcaatctaggacgaagagaggagtacgatgtttttggacaagagacgtggcc gggaccctgagatggggggaaagccgagaaggaagaaccctcaggaaggcctgtacaatgaactgcagaaagataag atggcggaggcctacagtgagattgggatgaaaggcgagcgccggaggggcaagggcacgatggcctttaccaggg tctcagtacagccaccaaggacacctacgacgcccttcacatgcaggccctgcccctcgctgataagtttaaactg ccagaacatttctctggcctaactggccggtaccggcttcatttttttccatttactgcagaggcttcatttttttcca tttactgcagaggcttcatttttttccatttactgcagaactagttaggcgtgtacggtgggaggcctatataagcag agctcgtttagtgaaccgtcagatcgcctggagacgccatccacgctgtttttgacctccatagaagacaccgggacc gatccagcctcgagagacccaatgctagccaccatggccttaccagtgaccgccttgctcctgccgctggccttgct gctccacgccgccaggccgtacttcggcaagctggaaagcaagctgagcgtgatccggaacctgaacgaccaggtgc tgttcatcgatcagggcaacagacccctgttcgaggacatgaccgacagcgactgcagagacaacgcccctcggacc atcttcatcatcagcatgtacaaggacagccagcctagaggcatggccgtgaccatctctgtgaagtgcgagaagat cagcaccctgagctgcgagaacaagatcatcagcttcaaagagatgaacccgccggacaacatcaaggacaccaaga gcgacatcatattcttccagcggagcgtgcccggccacgacaacaagatgcagtttgagagcagcagctacgagggc tacttcctggcctgcgagaaagagcgggacctgttcaagctgatcctgaagaaagaggacgaactgggcgaccgcag catcatgttcaccgtgcagaacgaggactgataa huMNC2-8-28-3z-Foxp3-NFAT-IL-18
(DNA)

(SEQ ID NO: 1646)

atggccttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagtg gctatgccatgagctgggtccgccaggctccagggaaggggctggagtgggtctcaaccattagtagtggcggaacc tacatatactaccccgactcagtgaagggccgattcaccatctccagagacaacgccaagaactcactgtatctgca -continued

```
aatgaacagcctgagagccgaggacacggccgtgtattactgtgcgagacttggggggggataattactacgaatact tcgatgtctggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcggagggaccaaggtggagatcaaacgaactacaacaacccctgcccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcaccctttactgcaggagtaagaggagcaggctcctgcacagtgactacatgaacatgactcctagaagacctg ggcctaccagaaagcattaccagccctatgccccaccacgcgacttcgcagcctatcgctccagagtgaagttcagc aggagcgcagacgcccccgcgtacaagcagggccagaaccagctctataacgagctcaatctaggacgaagagagga gtacgatgtttttggacaagagacgtggccgggaccctgagatggggggaaagccgagaaggaagaaccctcaggaag gcctgtacaatgaactgcagaaagataagatggcggaggcctacagtgagattgggatgaaaggcgagcgccggagg ggcaaggggcacgatggcctttaccagggtctcagtacagccaccaaggacacctacgacgcccttcacatgcaggc cctgcccctcgctgataagtttaaactgccagaacatttctctggcctaactggccggtaccggcttcatttttttc catttactgcagaggcttcatttttttccatttactgcagaggcttcatttttttccatttactgcagaactagttagg cgtgtacggtgggaggcctatataagcagagctcgtttagtgaaccgtcagatcgcctggagacgccatccacgctg ttttgacctccatagaagacaccgggaccgatccagcctcgagagacccaatgctagccaccatggccttaccagtg accgccttgctcctgccgctggccttgctgctccacgccgccaggccgtacttcggcaagctggaaagcaagctgag cgtgatccggaacctgaacgaccaggtgctgttcatcgatcagggcaacagacccctgttcgaggacatgaccgaca gcgactgcagagacaacgcccctcggaccatcttcatcatcagcatgtacaaggacagccagcctagaggcatggcc gtgaccatctctgtgaagtgcgagaagatcagcaccctgagctgcgagaacaagatcatcagcttcaaagagatgaa cccgccggacaacatcaaggacaccaagagcgacatcatattcttccagcggagcgtgcccggccacgacaacaaga tgcagtttgagagcagcagctacgagggctacttcctggcctgcgagaaagagcgggacctgttcaagctgatcctg aagaaagaggacgaactgggcgaccgcagcatcatgttcaccgtgcagaacgaggactgataa
``` muMNC2-8-4-1BB-3z1XX-Foxp3-NFAT-IL-18
(DNA)

(SEQ ID NO: 1647)
```
atggccttaccagtgaccgccttgctcctgccgctggccttgctgctccacgccgccaggccggaggtccagctgga ggagtcaggggggaggcttagtgaagcctggagggtccctgaaactctcctgtgcagcctctggattcactttcagtg gctatgccatgtcttgggttcgccagactccggagaagaggctggagtgggtcgcaaccattagtagtggtggtact tatatctactatccagacagtgtgaaggggcgattcaccatctccagagacaatgccaagaacaccctgtacctgca aatgagcagtctgaggtctgaggacacggccatgtattactgtgcaagacttggggggggataattactacgaatact tcgatgtctggggcgcagggaccacggtcaccgtctcctccgccaaaacgacacccccatctgtctatggcggtggc ggatccggcggtggcggatccggcggtggcggatccgacattgtgatcacacagtctacagcttccttaggtgtatc tctggggcagagggccaccatctcatgcagggccagcaaaagtgtcagtacatctggctatagttatatgcactggt accaacagagaccaggacagccacccaaactcctcatctatcttgcatccaacctagaatctggggtccctgccagg ttcagtggcagtgggtctgggacagacttcaccctcaacatccatcctgtggaggaggaggatgctgcaacctatta ctgtcagcacagtagggagcttccgttcacgttcggaggggggaccaagctggagataaaacgggctgatgctgcac caactgtatccacaacaacccctgcccccagacctcctaccccagccctacaattgccagccagcctctgagcctg aggcccgaggcttgtagacctgctgctggcggagccgtgcacaccagaggactggatttcgcctgcgacatctacat
```

-continued ctgggcgcccttggccgggacttgtggggtccttctcctgtcactggttatcaccctttactgcaaacggggcagaa agaaactcctgtatatattcaaacaaccatttatgagaccagtacaaactactcaagaggaagatggctgtagctgc cgatttccagaagaagaagaaggaggatgtgaactgagagtgaagttcagcaggagcgcagacgcccccgcgtacaa gcagggccagaaccagctctataacgagctcaatctaggacgaagagaggagtacgatgtttttggacaagagacgtg gccgggaccctgagatggggggaaagccgagaaggaagaaccctcaggaaggcctgttcaatgaactgcagaaagat aagatggcggaggccttcagtgagattgggatgaaaggcgagcgccggagggggcaaggggcacgatggccttttcca gggtctcagtacagccaccaaggacaccttcgacgcccttcacatgcaggccctgcccctcgctgataagtttaaa ctgccagaacatttctctggcctaactggccggtaccggcttcatttttttccatttactgcagaggcttcatttttt ccatttactgcagaggcttcatttttttccatttactgcagaactagttaggcgtgtacggtgggaggcctatataag cagagctcgtttagtgaaccgtcagatcgcctggagacgccatccacgctgtttttgacctccatagaagacaccggg accgatccagcctcgagagacccaatgctagccaccatggccttaccagtgaccgccttgctcctgccgctggcctt gctgctccacgccgccaggccgtacttcggcaagctggaaagcaagctgagcgtgatccggaacctgaacgaccagg tgctgttcatcgatcagggcaacagacccctgttcgaggacatgaccgacagcgactgcagagacaacgcccctcgg accatcttcatcatcagcatgtacaaggacagccagcctagaggcatggccgtgaccatctctgtgaagtgcgagaa gatcagoaccctgagctgcgagaacaagatcatcagcttcaaagagatgaacccgccggacaacatcaaggacacca agagogacatcatattcttccagcggagcgtgcccggccacgacaacaagatgcagtttgagagcagcagctacgag ggctacttcctggcctgcgagaaagagcgggacctgttcaagctgatcctgaagaaagaggacgaactgggcgaccg cagcatcatgttcaccgtgcagaacgaggactgataa huMNC2-8-4-1BB-3z1XX-Foxp3-NFAT-IL-18
(DNA)

(SEQ ID NO: 1648)
atggcccttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagtg gctatgccatgagctgggtccgccaggctccagggaaggggctggagtgggtctcaaccattagtagtggcggaacc tacatatactaccccgactcagtgaagggccgattcaccatctccagagacaacgccaagaactcactgtatctgca aatgaacagcctgagagccgaggacacggccgtgtattactgtgcgagacttggggggggataattactacgaatact tcgatgtctggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcgcgagggaccaaggtggagatcaaacgaactacaacaacccctgcccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcaccctttactgcaaacggggcagaaagaaactcctgtatatattcaaacaaccatttatgagaccagtacaaa ctactcaagaggaagatggctgtagctgccgatttccagaagaagaagaaggaggatgtgaactgagagtgaagttc agcaggagcgcagacgcccccgcgtacaagcagggccagaaccagctctataacgagctcaatctaggacgaagaga ggagtacgatgtttttggacaagagacgtggccgggaccctgagatggggggaaagccgagaaggaagaaccctcagg aaggcctgttcaatgaactgcagaaagataagatggcggaggccttcagtgagattgggatgaaaggcgagcgccgg aggggcaaggggcacgatggccttttccagggtctcagtacagccaccaaggacaccttcgacgcccttcacatgca ggccctgcccctcgctgataagtttaaactgccagaacatttctctggcctaactggccggtaccggcttcattttt ttccatttactgcagaggcttcatttttttccatttactgcagaggcttcatttttttccatttactgcagaactagtt -continued aggcgtgtacggtgggaggcctatataagcagagctcgtttagtgaaccgtcagatcgcctggagacgccatccacg ctgttttgacctccatagaagacaccgggaccgatccagcctcgagagacccaatgctagccaccatggccttacca gtgaccgccttgctcctgccgctggccttgctgctccacgccgccaggccgtacttcggcaagctggaaagcaagct gagcgtgatccggaacctgaacgaccaggtgctgttcatcgatcagggcaacagacccctgttcgaggacatgaccg acagcgactgcagagacaacgcccctcggaccatcttcatcatcagcatgtacaaggacagccagcctagaggcatg gccgtgaccatctctgtgaagtgcgagaagatcagcaccctgagctgcgagaacaagatcatcagcttcaaagagat gaacccgccggacaacatcaaggacaccaagagcgacatcatattcttccagcggagcgtgcccggccacgacaaca agatgcagtttgagagcagcagctacgagggctacttcctggcctgcgagaaagagcgggacctgttcaagctgatc ctgaagaaagaggacgaactgggcgaccgcagcatcatgttcaccgtgcagaacgaggactgataa muMNC2-8-28-3z1XX-Foxp3-NFAT-IL-18
(DNA)

(SEQ ID NO: 1649)

atggcccttaccagtgaccgccttgctcctgccgctggccttgctgctccacgccgccaggccggaggtccagctgga ggagtcaggggggaggcttagtgaagcctggagggtccctgaaactctcctgtgcagcctctggattcactttcagtg gctatgccatgtcttgggttcgccagactccggagaagaggctggagtgggtcgcaaccattagtagtggtggtact tatatctactatccagacagtgtgaaggggcgattcaccatctccagagacaatgccaagaacaccctgtacctgca aatgagcagtctgaggtctgaggacacggccatgtattactgtgcaagacttggggggggataattactacgaatact tcgatgtctggggcgcagggaccacggtcaccgtctcctccgccaaaacgacacccccatctgtctatggcggtggc ggatccggcggtggcggatccggcggtggcggatccgacattgtgatcacacagtctacagcttccttaggtgtatc tctggggcagagggccaccatctcatgcagggccagcaaaagtgtcagtacatctggctatagttatatgcactggt accaacagagaccaggacagccacccaaactcctcatctatcttgcatccaacctagaatctggggtccctgccagg ttcagtggcagtgggtctgggacagacttcaccctcaacatccatcctgtggaggaggaggatgctgcaacctatta ctgtcagcacagtagggagcttccgttcacgttcggaggggggaccaagctggagataaaacgggctgatgctgcac caactgtatccacaacaaccctgcccccagacctcctaccccagccctacaattgccagccagcctctgagcctg aggcccgaggcttgtagacctgctgctggcggagccgtgcacaccagaggactggatttcgcctgcgacatctacat ctgggcgcccttggccgggacttgtggggtccttctcctgtcactggttatcacccttactgcaggagtaagagga gcaggctcctgcacagtgactacatgaacatgactcctagaagacctgggcctaccagaaagcattaccagcccctat gcccaccacgcgacttcgcagcctatcgctccagagtgaagttcagcaggagcgcagacgcccccgcgtacaagca gggccagaaccagctctataacgagctcaatctaggacgaagagaggagtacgatgtttggacaagagacgtggcc gggaccctgagatggggggaaagccgagaaggaagaaccctcaggaaggcctgttcaatgaactgcagaaagataag atggcggaggccttcagtgagattgggatgaaaggcgagcgccggaggggcaaggggcacgatggcctttccaggg tctcagtacagccaccaaggacaccttcgacgcccttcacatgcaggccctgccccctcgctgataagtttaaactg ccagaacatttctctggcctaactggccggtaccggcttcatttttttccatttactgcagaggcttcatttttttcca tttactgcagaggcttcatttttttccatttactgcagaactagttaggcgtgtacggtgggaggcctatataagcag agctcgtttagtgaaccgtcagatcgcctggagacgccatccacgctgttttgacctccatagaagacaccgggacc gatccagctcgagagacccaatgctagccaccatggccttaccagtgaccgccttgctcctgccgctggccttgct gctccacgccgccaggccgtacttcggcaagctggaaagcaagctgagcgtgatccggaacctgaacgaccaggtgc tgttcatcgatcagggcaacagacccctgttcgaggacatgaccgacagcgactgcagagacaacgcccctcggacc atcttcatcatcagcatgtacaaggacagccagcctagaggcatggccgtgaccatctctgtgaagtgcgagaagat cagcaccctgagctgcgagaacaagatcatcagcttcaaagagatgaacccgccggacaacatcaaggacaccaaga -continued gcgacatcatattcttccagcggagcgtgcccggccacgacaacaagatgcagtttgagagcagcagctacgagggc tacttcctggcctgcgagaaagagcgggacctgttcaagctgatcctgaagaaagaggacgaactgggcgaccgcag catcatgttcaccgtgcagaacgaggactgataa huMNC2-8-28-3z1XX-Foxp3-NFAT-IL-18
(DNA)

(SEQ ID NO: 1650)

atggccttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagtg gctatgccatgagctgggtccgccaggctccagggaaggggctggagtgggtctcaaccattagtagtggcggaacc tacatatactaccccgactcagtgaagggccgattcaccatctccagagacaacgccaagaactcactgtatctgca aatgaacagcctgagagccgaggacacggccgtgtattactgtgcgagacttgggggggataattactacgaatact tcgatgtctggggcaaagggaccacggtcaccgtctcctccggcggtggcggatccggcggtggcggatccggcggt ggcggatccgacattgtgctgacccagtctccagcctccttggccgtgtctccaggacagagggccaccatcacctg cagagccagtaagagtgtcagtaccagcggatactcctacatgcactggtatcagcagaaaccaggacaacctccta aactcctgatttacctggcatccaatctggagagcggggtcccagccaggttcagcggcagtgggtctgggaccgat ttcaccctcacaattaatcctgtggaagctaatgatactgcaaattattactgtcagcacagtagggagctgccttt cacattcggcggagggaccaaggtggagatcaaacgaactacaacaacccctgcccccagacctcctaccccagccc ctacaattgccagccagcctctgagcctgaggcccgaggcttgtagacctgctgctggcggagccgtgcacaccaga ggactggatttcgcctgcgacatctacatctgggcgcccttggccgggacttgtggggtccttctcctgtcactggt tatcaccctttactgcaggagtaagaggagcaggctcctgcacagtgactacatgaacatgactcctagaagacctg ggcctaccagaaagcattaccagccctatgccccaccacgcgacttcgcagcctatcgctccagagtgaagttcagc aggagcgcagacgcccccgcgtacaagcagggccagaaccagctctataacgagctcaatctaggacgaagagagga gtacgatgttttggacaagagacgtggccgggaccctgagatggggggaaagccgagaaggaagaaccctcaggaag gcctgttcaatgaactgcagaaagataagatggcggaggccttcagtgagattgggatgaaaggcgagcgccggagg ggcaaggggcacgatggcctttttccagggtctcagtacagccaccaaggacaccttcgacgcccttcacatgcaggc cctgcccctcgctgataagtttaaactgccagaacatttctctggcctaactggccggtaccggcttcatttttttc catttactgcagaggcttcatttttttccatttactgcagaggcttcatttttttccatttactgcagaactagttagg cgtgtacggtgggaggcctatataagcagagctcgtttagtgaaccgtcagatcgcctggagacgccatccacgctg ttttgacctccatagaagacaccgggaccgatccagcctcgagagacccaatgctagccaccatggccttaccagtg accgccttgctcctgccgctggccttgctgctccacgccgccaggccgtacttcggcaagctggaaagcaagctgag cgtgatccggaacctgaacgaccaggtgctgttcatcgatcagggcaacagacccctgttcgaggacatgaccgaca gcgactgcagagacaacgcccctcggaccatcttcatcatcagcatgtacaaggacagccagcctagaggcatggcc gtgaccatctctgtgaagtgcgagaagatcagcaccctgagctgcgagaacaagatcatcagcttcaaagagatgaa cccgccggacaacatcaaggacaccaagagcgacatcatattcttccagcggagcgtgcccggccacgacaacaaga tgcagtttgagagcagcagctacgagggctacttcctggcctgcgagaaagagcgggacctgttcaagctgatcctg aagaaagaggacgaactgggcgaccgcagcatcatgttcaccgtgcagaacgaggactgataa
MNE6 muMNE6-8-4-11313-3z-Foxp3-NFAT-IL-18
(DNA)

(SEQ ID NO: 1651)

atggccttaccagtgaccgccttgctcctgccgctggccttgctgctccacgccgccaggccggaggtgaaggtggt ggagtctggggggagacttagtgaagcctggagggtccctgaaactctcctgtgtagtctctggattcactttcagta gatatggcatgtcttgggttcgccagactccaggcaagaggctggagtgggtcgcaaccattagtggtggcggtact tacatctactatccagacagtgtgaagggccgattcaccatctccagagacaatgccaagaacaccctgtacctgca -continued

```
aatgagcagtctgaagtctgaggacacagccatgtatcactgtacaagggataactacggtaggaactacgactacg gtatggactactggggtcaaggaacctcagtcaccgtctcctcaggcggtggcggatccggcggtggcggatccggc ggtggcggatcccaaattgttctcacccagtctccagcaatcatgtctgcatctccaggggaggaggtcaccctaac ctgcagtgccacctcaagtgtaagttacatacactggttccagcagaggccaggcacttctcccaaactctggattt atagcacatccaacctggcttctggagtccctgttcgcttcagtggcagtggatatgggacctcttactctctcaca atcagccgaatggaggctgaagatgctgccacttattactgccagcaaaggagtagttccccattcacgttcggctc ggggacaaagttggaaataaaaacaacaacccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcaa acggggcagaaagaaactcctgtatatattcaaacaaccatttatgagaccagtacaaactactcaagaggaagatg gctgtagctgccgatttccagaagaagaagaaggaggatgtgaactgagagtgaagttcagcaggagcgcagacgcc cccgcgtacaagcagggccagaaccagctctataacgagctcaatctaggacgaagagaggagtacgatgtttttgga caagagacgtggccgggaccctgagatggggggaaagccgagaaggaagaaccctcaggaaggcctgtacaatgaac tgcagaaagataagatggcggaggcctacagtgagattgggatgaaaggcgagcgccggaggggcaaggggcacgat ggcctttaccagggtctcagtacagccaccaaggacacctacgacgcccttcacatgcaggccctgccccctcgctg ataagtttaaactgccagaacatttctctggcctaactggccggtaccggcttcattttttccatttactgcagagg cttcattttttccatttactgcagaggcttcatttttttccatttactgcagaactagttaggcgtgtacggtgggag gcctatataagcagagctcgtttagtgaaccgtcagatcgcctggagacgccatccacgctgtttttgacctccatag aagacaccgggaccgatccagcctcgagagacccaatgctagccaccatggccttaccagtgaccgccttgctcctg ccgctggccttgctgctccacgccgccaggccgtacttcggcaagctggaaagcaagctgagcgtgatccggaacct gaacgaccaggtgctgttcatcgatcagggcaacagacccctgttcgaggacatgaccgacagcgactgcagagaca acgcccctcggaccatcttcatcatcagcatgtacaaggacagccagcctagaggcatggccgtgaccatctctgtg aagtgcgagaagatcagcaccctgagctgcgagaacaagatcatcagcttcaaagagatgaacccgccggacaacat caaggacaccaagagcgacatcatattcttccagcggagcgtgcccggccacgacaacaagatgcagtttgagagca gcagctacgagggctacttcctggcctgcgagaaagagcgggacctgttcaagctgatcctgaagaaagaggacgaa ctgggcgaccgcagcatcatgttcaccgtgcagaacgaggactgataa
``` huMNE6-8-4-1BB-3z-Foxp3-NFAT-IL-18
(DNA)

(SEQ ID NO: 1652)

```
atggcccttaccagtgaccgccttgctcctgccgctggccttgctgctccacgccgccaggccggaggtgcagctggt ggagtctggggggaggcctggtcaagcctggggggtccctgagactctcctgtgcagcctctggattcaccttcagta ggtatggcatgagctgggtccgccaggctccagggaagaggctggagtgggtctcaaccattagtggcgggaggcacc tacatatactacccagactcagtgaagggccgattcaccatctccagagacaacgccaagaacaccctgtatctgca aatgaacagcctgagagccgaggacacggctgtgtattactgtaccagagataactatggccgcaactatgattatg gcatggattattggggccagggcaccctggtgaccgtgagcagcggcggtggcggatccggcggtggcggatccggc ggtggcggatccgaaattgtgttgacacagtctccagccaccctgtctttgtctccaggggaaagagccaccctcac ctgcagcgccaccagcagtgttagctacatccactggtaccaacagaggcctggccagagccccaggctcctcatct atagcacctccaacctggcagcggcatcccagccaggttcagtggcagtgggtctgggagcgactacactctcacc atcagcagcctagagcctgaagattttgcagtttattactgtcagcagcgtagcagctcccccttcaccttggcag cggcaccaaagtggaaattaaaacaacaacccctgccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcaa
```

-continued

```
acggggcagaaagaaactcctgtatatattcaaacaaccatttatgagaccagtacaaactactcaagaggaagatg gctgtagctgccgatttccagaagaagaagaaggaggatgtgaactgagagtgaagttcagcaggagcgcagacgcc cccgcgtacaagcagggccagaaccagctctataacgagctcaatctaggacgaagagaggagtacgatgtttttgga caagagacgtggccgggaccctgagatggggggaaagccgagaaggaagaaccctcaggaaggcctgtacaatgaac tgcagaaagataagatggcggaggcctacagtgagattgggatgaaaggcgagcgccggaggggcaaggggcacgat ggcctttaccagggtctcagtacagccaccaaggacacctacgacgcccttcacatgcaggccctgccccctcgctg ataagtttaaactgccagaacatttctctggcctaactggccggtaccggcttcattttttccatttactgcagagg cttcattttttccatttactgcagaggcttcattttttccatttactgcagaactagttaggcgtgtacggtgggag gcctatataagcagagctcgtttagtgaaccgtcagatcgcctggagacgccatccacgctgtttttgacctccatag aagacaccgggaccgatccagcctcgagagacccaatgctagccaccatggccttaccagtgaccgccttgctcctg ccgctggccttgctgctccacgccgccaggccgtacttcggcaagctggaaagcaagctgagcgtgatccggaacct gaacgaccaggtgctgttcatcgatcagggcaacagacccctgttcgaggacatgaccgacagcgactgcagagaca acgcccctcggaccatcttcatcatcagcatgtacaaggacagccagcctagaggcatggccgtgaccatctctgtg aagtgcgagaagatcagcaccctgagctgcgagaacaagatcatcagcttcaaagagatgaacccgccggacaacat caaggacaccaagagcgacatcatattcttccagcggagcgtgcccggccacgacaacaagatgcagtttgagagca gcagctacgagggctacttcctggcctgcgagaaagagcgggacctgttcaagctgatcctgaagaaagaggacgaa ctgggcgaccgcagcatcatgttcaccgtgcagaacgaggactgataa
``` muMNE6-8-4-28-3z-Foxp3-NFAT-IL-18
(DNA)
                                                       (SEQ ID NO: 1653)

```
atggccttaccagtgaccgccttgctcctgccgctggccttgctgctccacgccgccaggccggaggtgaaggtggt ggagtctggggagacttagtgaagcctggagggtccctgaaactctcctgtgtagtctctggattcactttcagta gatatggcatgtcttgggttcgccagactccaggcaagaggctggagtgggtcgcaaccattagtggtggcggtact tacatctactatccagacagtgtgaaggggcgattcaccatctccagagacaatgccaagaacaccctgtacctgca aatgagcagtctgaagtctgaggacacagccatgtatcactgtacaagggataactacggtaggaactacgactacg gtatggactactggggtcaaggaacctcagtcaccgtctcctcaggcggtggcgatccggcggtggcggatccggc ggtggcggatcccaaattgttctcacccagtctccagcaatcatgtctgcatctccaggggaggaggtcaccctaac ctgcagtgccacctcaagtgtaagttacatacactggttccagcagaggccaggcacttctcccaaactctggattt atagcacatccaacctggcttctggagtccctgttcgcttcagtggcagtggatatgggacctcttactctctcaca atcagccgaatggaggctgaagatgctgccacttattactgccagcaaaggagtagttccccattcacgttcggctc ggggacaaagttggaaataaaaacaacaacccctgcccccagacctcctaccccagccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcaccctttactgcag gagtaagaggagcaggctcctgcacagtgactacatgaacatgactcctagaagacctgggcctaccagaaagcatt accagccctatgcccaccacgcgacttcgcagcctatcgctccagagtgaagttcagcaggagcgcagacgcccccc gcgtacaagcagggccagaaccagctctataacgagctcaatctaggacgaagagaggagtacgatgtttttggacaa gagacgtggccgggaccctgagatggggggaaagccgagaaggaagaaccctcaggaaggcctgtacaatgaactgc agaaagataagatggcggaggcctacagtgagattgggatgaaaggcgagcgccggaggggcaaggggcacgatggc ctttaccagggtctcagtacagccaccaaggacacctacgacgcccttcacatgcaggccctgccccctcgctgata agtttaaactgccagaacatttctctggcctaactggccggtaccggcttcattttttccatttactgcagaggctt cattttttccatttactgcagaggcttcattttttccatttactgcagaactagttaggcgtgtacggtgggaggcc tatataagcagagctcgtttagtgaaccgtcagatcgcctggagacgccatccacgctgtttttgacctccatagaag
```

-continued acaccgggaccgatccagcctcgagagacccaatgctagccaccatggccttaccagtgaccgccttgctcctgccg ctggccttgctgctccacgccgccaggccgtacttcggcaagctggaaagcaagctgagcgtgatccggaacctgaa cgaccaggtgctgttcatcgatcagggcaacagacccctgttcgaggacatgaccgacagcgactgcagagacaacg cccctcggaccatcttcatcatcagcatgtacaaggacagccagcctagaggcatggccgtgaccatctctgtgaag tgcgagaagatcagcaccctgagctgcgagaacaagatcatcagcttcaaagagatgaacccgccggacaacatcaa ggacaccaagagcgacatcatattcttccagcggagcgtgcccggccacgacaacaagatgcagtttgagagcagca gctacgagggctacttcctggcctgcgagaaagagcgggacctgttcaagctgatcctgaagaaagaggacgaactg ggcgaccgcagcatcatgttcaccgtgcagaacgaggactgataa huMNE6-8-28-3z-Foxp3-NFAT-IL-18
(DNA)

(SEQ ID NO: 1654)
atggccttaccagtgaccgccttgctcctgccgctggccttgctgctccacgccgccaggccggaggtgcagctggt ggagtctgggggaggcctggtcaagcctggggggtccctgagactctcctgtgcagcctctggattcaccttcagta ggtatggcatgagctgggtccgccaggctccagggaagaggctggagtgggtctcaaccattagtggcggaggcacc tacatatactacccagactcagtgaagggccgattcaccatctccagagacaacgccaagaacaccctgtatctgca aatgaacagcctgagagccgaggacacggctgtgtattactgtaccagagataactatggccgcaactatgattatg gcatggattattggggccagggcaccctggtgaccgtgagcagcggcggtggcggatccggcggtggcggatccggc ggtggcggatccgaaattgtgttgacacagtctccagccaccctgtctttgtctccaggggaaagagccaccctcac ctgcagcgccaccagcagtgttagctacatccactggtaccaacagaggcctggccagagccccaggctcctcatct atagcacctccaacctggccagcggcatcccagccaggttcagtggcagtgggtctgggagcgactacactctcacc atcagcagcctagagcctgaagattttgcagtttattactgtcagcagcgtagcagctcccctttcacctttggcag cggcaccaaagtggaaattaaaacaacaacccctgccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcag gagtaagaggagcaggctcctgcacagtgactacatgaacatgactcctagaagacctgggcctaccagaaagcatt accagccctatgcccaccacgcgacttcgcagcctatcgctccagagtgaagttcagcaggagcgcagacgcccccc gcgtacaagcagggccagaaccagctctataacgagctcaatctaggacgaagagaggagtacgatgttttggacaa gagacgtggccgggaccctgagatggggggaaagccgagaaggaagaaccctcaggaaggcctgtacaatgaactgc agaaagataagatggcggaggcctacagtgagattgggatgaaaggcgagcgccggagggggcaagggggcacgatggc ctttaccagggtctcagtacagccaccaaggacacctacgacgcccttcacatgcaggccctgcccctcgctgata agtttaaactgccagaacatttctctggcctaactggccggtaccggcttcattttttccatttactgcagaggctt catttttttccatttactgcagaggcttcatttttttccatttactgcagaactagttaggcgtgtacggtgggaggcc tatataagcagagctcgtttagtgaaccgtcagatcgcctggagacgccatccacgctgtttgacctccatagaag acaccgggaccgatccagcctcgagagacccaatgctagccaccatggccttaccagtgaccgccttgctcctgccg ctggccttgctgctccacgccgccaggccgtacttcggcaagctggaaagcaagctgagcgtgatccggaacctgaa cgaccaggtgctgttcatcgatcagggcaacagacccctgttcgaggacatgaccgacagcgactgcagagacaacg cccctcggaccatcttcatcatcagcatgtacaaggacagccagcctagaggcatggccgtgaccatctctgtgaag tgcgagaagatcagcaccctgagctgcgagaacaagatcatcagcttcaaagagatgaacccgccggacaacatcaa ggacaccaagagcgacatcatattcttccagcggagcgtgcccggccacgacaacaagatgcagtttgagagcagca gctacgagggctacttcctggcctgcgagaaagagcgggacctgttcaagctgatcctgaagaaagaggacgaactg ggcgaccgcagcatcatgttcaccgtgcagaacgaggactgataa -continued muMNE6-8-4-1BB-3z1XX-Foxp3-NFAT-IL-18
(DNA)

(SEQ ID NO: 1655)

atggccttaccagtgaccgccttgctcctgccgctggccttgctgctccacgccgccaggccggaggtgaaggtggt ggagtctggggggagacttagtgaagcctggagggtccctgaaactctcctgtgtagtctctggattcactttcagta gatatggcatgtcttgggttcgccagactccaggcaagaggctggagtgggtcgcaaccattagtggtggcggtact tacatctactatccagacagtgtgaaggggcgattcaccatctccagagacaatgccaagaacaccctgtacctgca aatgagcagtctgaagtctgaggacacagccatgtatcactgtacaagggataactacggtaggaactacgactacg gtatggactactggggtcaaggaacctcagtcaccgtctcctcaggcggtggcggatccggcggtggcggatccggc ggtggcggatcccaaattgttctcacccagtctccagcaatcatgtctgcatctccaggggaggaggtcaccctaac ctgcagtgccacctcaagtgtaagttacatacactggttccagcagaggccaggcacttctcccaaactctggattt atagcacatccaacctggcttctggagtccctgttcgcttcagtggcagtggatatgggacctcttactctctcaca atcagccgaatggaggctgaagatgctgccacttattactgccagcaaaggagtagttcccattcacgttcggctc ggggacaaagttggaaataaaaacaacaacccctgccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccttactgcaa acggggcagaaagaaactcctgtatatattcaaacaaccatttatgagaccagtacaaactactcaagaggaagatg gctgtagctgccgatttccagaagaagaagaaggaggatgtgaactgagagtgaagttcagcaggagcgcagacgcc cccgcgtacaagcagggccagaaccagctctataacgagctcaatctaggacgaagagaggagtacgatgttttgga caagagacgtggccgggaccctgagatggggggaaagccgagaaggaagaaccctcaggaaggcctgttcaatgaac tgcagaaagataagatggcggaggccttcagtgagattgggatgaaaggcgagcgccggaggggcaagggggcacgat ggccttttccagggtctcagtacagccaccaaggacaccttcgacgcccttcacatgcaggccctgcccctcgctg ataagtttaaactgccagaacatttctctggcctaactggccggtaccggcttcatttttttccatttactgcagagg cttcatttttttccatttactgcagaggcttcatttttttccatttactgcagaactagttaggcgtgtacggtgggag gcctatataagcagagctcgtttagtgaaccgtcagatcgcctggagacgccatccacgctgtttttgacctccatag aagacaccgggaccgatccagcctcgagagacccaatgctagccaccatggccttaccagtgaccgccttgctcctg ccgctggccttgctgctccacgccgccaggccgtacttcggcaagctggaaagcaagctgagcgtgatccggaacct gaacgaccaggtgctgttcatcgatcagggcaacagacccctgttcgaggacatgaccgacagcgactgcagagaca acgcccctcggaccatcttcatcatcagcatgtacaaggacagccagcctagaggcatggccgtgaccatctctgtg aagtgcgagaagatcagcacccctgagctgcgagaacaagatcatcagcttcaaagagatgaacccgccggacaacat caaggacaccaagagcgacatcatattcttccagcggagcgtgcccggccacgacaacaagatgcagtttgagagca gcagctacgagggctacttcctggcctgcgagaaagagcgggacctgttcaagctgatcctgaagaaagaggacgaa ctgggcgaccgcagcatcatgttcaccgtgcagaacgaggactgataa huMNE6-8-4-1BB-3z1XX-Foxp3-NFAT-IL-18
(DNA)

(SEQ ID NO: 1656)

atggccttaccagtgaccgccttgctcctgccgctggccttgctgctccacgccgccaggccggaggtgcagctggt ggagtctggggggaggccttggtcaagcctggggggtccctgagactctcctgtgcagcctctggattcaccttcagta ggtatggcatgagctgggtccgccaggctccagggaagaggctggagtgggtctcaaccattagtggcggaggcacc tacatatactacccagactcagtgaagggccgattcaccatctccagagacaacgccaagaacaccctgtatctgca aatgaacagcctgagagccgaggacacggctgtgtattactgtaccagagataactatggccgcaactatgattatg gcatggattattggggccagggcaccctggtgaccgtgagcagcggcggtggcggatccggcggtggcggatccggc ggtggcggatccgaaattgtgttgacacagtctccagccaccctgtctttgtctccaggggaaagagccaccctcac -continued ctgcagcgccaccagcagtgttagctacatccactggtaccaacagaggcctggccagagccccaggctcctcatct atagcacctccaacctggccagcggcatcccagccaggttcagtggcagtgggtctgggagcgactacactctcacc atcagcagctagagcctgaagattttgcagtttattactgtcagcagcgtagcagctcccctttcacctttggcag cggcaccaaagtggaaattaaaacaacaacccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccctttactgcaa acggggcagaaagaaactcctgtatatattcaaacaaccatttatgagaccagtacaaactactcaagaggaagatg ggtgtagctgccgatttccagaagaagaagaaggaggatgtgaactgagagtgaagttcagcaggagcgcagacgcc cccgcgtacaagcagggccagaaccagctctataacgagctcaatctaggacgaagagaggagtacgatgtttttgga caagagacgtggcgggacccctgagatggggggaaagccgagaaggaagaaccctcaggaaggcctgttcaatgaac tgcagaaagataagatggcggaggccttcagtgagattgggatgaaaggcgagcgccggaggggcaaggggcacgat ggccttttccagggtctcagtacagccaccaaggacaccttcgacgcccttcacatgcaggccctgcccctcgctg ataagtttaaactgcagaacatttctctggcctaactggccggtaccggcttcattttttccatttactgcagagg cttcattttttccatttactgcagaggcttcattttttccatttactgcagaactagttaggcgtgtacggtgggag goctatataagcagagctcgtttagtgaaccgtcagatcgcctggagacgccatccacgctgtttttgacctccatag aagacaccgggaccgatccagcctcgagagacccaatgctagccaccatggccttaccagtgaccgccttgctcctg ccgctggccttgctgctccacgccgccaggccgtacttcggcaagctggaaagcaagctgagcgtgatccggaacct gaacgaccaggtggtgttcatcgatcagggcaacagacccctgttcgaggacatgaccgacagcgactgcagagaca acgcccctcggaccatcttcatcatcagcatgtacaaggacagccagcctagaggcatggccgtgaccatctctgtg aagtgcgagaagatcagcaccctgagctgcgagaacaagatcatcagcttcaaagagatgaacccgccggacaacat caaggacaccaagagcgacatcatattcttccagcggagcgtgcccggccacgacaacaagatgcagtttgagagca gcagctacgagggctacttcctggcctgcgagaaagagcgggacctgttcaagctgatcctgaagaaagaggacgaa ctgggcgaccgcagcatcatgttcaccgtgcagaacgaggactgataa muMNE6-8-28-3z1XX-Foxp3-NFAT-IL-18
(DNA)

(SEQ ID NO: 1657)

atggccttaccagtgaccgccttgctcctgccgctggccttgctgctccacgccgccaggccggaggtgaaggtggt ggagtctgggggagacttagtgaagcctggagggtccctgaaactctcctgtgtagtctctggattcactttcagta gatatggcatgtcttgggttcgccagactccaggcaagaggctggagtgggtcgcaaccattagtggtggcggtact tacatctactatccagacagtgtgaaggggcgattcaccatctccagagacaatgccaagaacaccctgtacctgca aatgagcagtctgaagtctgaggacacagccatgtatcactgtacaagggataactacggtaggaactacgactacg gtatggactactggggtcaaggaacctcagtcaccgtctcctcaggcggtggcggatccggcggtggcggatccggc ggtggcggatcccaaattgttctcacccagtctccagcaatcatgtctgcatctccaggggaggaggtcaccctaac ctgcagtgccacctcaagtgtaagttacatacactggttccagcagaggccaggcacttctcccaaactctggatt tatagcacatccaacctggcttctggagtccctgttcgcttcagtggcagtggatatgggacctcttactctctcaca atcagccgaatggaggctgaagatgctgccacttattactgccagcaaaggagtagttccccattcacgttcggctc ggggacaaagttggaaataaaaacaacaaccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcacccctttactgcag gagtaagaggagcaggctcctgcacagtgactacatgaacatgactcctagaagacctgggcctaccagaaagcatt accagccctatgccccaccacgcgacttcgcagcctatcgctccagagtgaagttcagcaggagcgcagacgccccc -continued gcgtacaagcagggccagaaccagctctataacgagctcaatctaggacgaagagaggagtacgatgttttggacaa gagacgtggccgggaccctgagatgggggaaagccgagaaggaagaaccctcaggaaggcctgttcaatgaactgc agaaagataagatggcggaggccttcagtgagattgggatgaaaggcgagcgccggaggggcaaggggcacgatggc cttttccagggtctcagtacagccaccaaggacaccttcgacgcccttcacatgcaggccctgcccctcgctgata agtttaaactgccagaacatttctctggcctaactggccggtaccggcttcatttttccatttactgcagaggctt catttttccatttactgcagaggcttcatttttccatttactgcagaactagttaggcgtgtacggtgggaggcc tatataagcagagctcgtttagtgaaccgtcagatcgcctggagacgccatccacgctgttttgacctccatagaag acaccgggaccgatccagcctcgagagacccaatgctagccaccatggccttaccagtgaccgccttgctcctgccg ctggccttgctgctccacgccgccaggccgtacttcggcaagctggaaagcaagctgagcgtgatccggaacctgaa cgaccaggtgctgttcatcgatcagggcaacagacccctgttcgaggacatgaccgacagcgactgcagagacaacg cccctcggaccatcttcatcatcagcatgtacaaggacagccagcctagaggcatggccgtgaccatctctgtgaag tgcgagaagatcagcaccctgagctgcgagaacaagatcatcagcttcaaagagatgaacccgccggacaacatcaa ggacaccaagagcgacatcatattcttccagcggagcgtgcccggccacgacaacaagatgcagtttgagagcagca gctacgagggctacttcctggcctgcgagaaagagcgggacctgttcaagctgatcctgaagaaagaggacgaactg
ggcgaccgcagcatcatgttcaccgtgcagaacgaggactgataa huMNE6-8-28-3z1XX-Foxp3-NFAT-IL-18
(DNA)

(SEQ ID NO: 1658)
atggcccttaccagtgaccgccttgctcctgccgctggccttgctgctccacgccgccaggccggaggtgcagctggt ggagtctgggggaggcctggtcaagcctggggggtccctgagactctcctgtgcagcctctggattcaccttcagta ggtatggcatgagctgggtccgccaggctccagggaagaggctggagtgggtctcaaccattagtggcggaggcacc tacatatactacccagactcagtgaagggccgattcaccatctccagagacaacgccaagaacaccctgtatctgca aatgaacagcctgagagccgaggacacggctgtgtattactgtaccagagataactatggccgcaactatgattatg gcatggattattggggccagggcaccctggtgaccgtgagcagcggcggtggcggatccggcggtggcggatccggc ggtggcggatccgaaattgtgttgacacagtctccagccaccctgtctttgtctccaggggaaagagccaccctcac ctgcagcgccaccagcagtgttagctacatccactggtaccaacagaggcctggccagagccccaggctcctcatct atagcacctccaacctggccagcggcatcccagccaggttcagtggcagtgggtctgggagcgactacactctcacc atcagcagcctagagcctgaagattttgcagtttattactgtcagcagcgtagcagctcccctttcacctttggcag cggcaccaaagtggaaattaaaacaacaacccctgcccccagacctcctaccccagcccctacaattgccagccagc ctctgagcctgaggcccgaggcttgtagacctgctgctggcggagccgtgcacaccagaggactggatttcgcctgc gacatctacatctgggcgcccttggccgggacttgtggggtccttctcctgtcactggttatcaccctttactgcag gagtaagaggagcaggctcctgcacagtgactacatgaacatgactcctagaagacctgggcctaccagaaagcatt accagccctatgccccaccacgcgacttcgcagcctatcgctccagagtgaagttcagcaggagcgcagacgccccc gcgtacaagcagggccagaaccagctctataacgagctcaatctaggacgaagagaggagtacgatgttttggacaa gagacgtggccgggaccctgagatgggggaaagccgagaaggaagaaccctcaggaaggcctgttcaatgaactgc agaaagataagatggcggaggccttcagtgagattgggatgaaaggcgagcgccggaggggcaaggggcacgatggc cttttccagggtctcagtacagccaccaaggacaccttcgacgcccttcacatgcaggccctgcccctcgctgata agtttaaactgccagaacatttctctggcctaactggccggtaccggcttcatttttccatttactgcagaggctt catttttccatttactgcagaggcttcatttttccatttactgcagaactagttaggcgtgtacggtgggaggcc tatataagcagagctcgtttagtgaaccgtcagatcgcctggagacgccatccacgctgttttgacctccatagaag acaccgggaccgatccagcctcgagagacccaatgctagccaccatggccttaccagtgaccgccttgctcctgccg ctggccttgctgctccacgccgccaggccgtacttcggcaagctggaaagcaagctgagcgtgatccggaacctgaa -continued cgaccaggtgctgttcatcgatcagggcaacagacccctgttcgaggacatgaccgacagcgactgcagagacaacg cccctcggaccatcttcatcatcagcatgtacaaggacagccagcctagaggcatggccgtgaccatctctgtgaag tgcgagaagatcagcaccctgagctgcgagaacaagatcatcagcttcaaagagatgaacccgccggacaacatcaa ggacaccaagagcgacatcatattcttccagcggagcgtgcccggccacgacaacaagatgcagtttgagagcagca gctacgagggctacttcctggcctgcgagaaagagcgggacctgttcaagctgatcctgaagaaagaggacgaactg ggcgaccgcagcatcatgttcaccgtgcagaacgaggactgataa 20A10
mu20A10-8-4-1BB-3z-Foxp3-NFAT-IL-18
(DNA)

(SEQ ID NO: 1659)

atggccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaacccctgcccccagacctcctacccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtgggtccttctcctgtcactggttatcac cctttactgcaaacggggcagaaagaaactcctgtatatattcaaacaaccatttatgagaccagtacaaactactc aagaggaagatggctgtagctgccgatttccagaagaagaagaaggaggatgtgaactgagagtgaagttcagcagg agcgcagacgcccccgcgtacaagcagggccagaaccagctctataacgagctcaatctaggacgaagagaggagta cgatgtttggacaagagacgtggccgggaccctgagatggggggaaagccgagaaggaagaaccctcaggaaggcc tgtacaatgaactgcagaaagataagatggcggaggcctacagtgagattgggatgaaaggcgagcgccggaggggc aaggggcacgatggcctttaccagggtctcagtacagccaccaaggacacctacgacgcccttcacatgcaggccct gccccctcgctgataagtttaaactgccagaacatttctctggcctaactggccggtaccggcttcatttttttccat ttactgcagaggcttcattttttccatttactgcagaggcttcatttttttccatttactgcagaactagttaggcgt gtacggtgggaggcctatataagcagagctcgtttagtgaaccgtcagatcgcctggagacgccatccacgctgttt tgacctccatagaagacaccgggaccgatccagcctcgagagacccaatgctagccaccatggccttaccagtgacc gccttgctcctgccgctggccttgctgctccacgccgccaggccgtacttcggcaagctggaaagcaagctgagcgt gatcggaacctgaacgaccaggtgctgttcatcgatcagggcaacagacccctgttcgaggacatgaccgacagcg actgcagagacaacgcccctcggaccatcttcatcatcagcatgtacaaggacagccagcctagaggcatggccgtg accatctctgtgaagtgcgagaagatcagcaccctgagctgcgagaacaagatcatcagcttcaaagagatgaaccc gcggacaacatcaaggacaccaagagcgacatcatattcttccagcggagcgtgcccggccacgacaacaagatgc agtttgagagcagcagctacgagggctacttcctggcctgcgagaaagagcgggacctgttcaagctgatcctgaag aaagaggacgaactgggcgaccgcagcatcatgttcaccgtgcagaacgaggactgataa -continued hu20A10-8-4-1BB-3z-Foxp3-NFAT-IL-18
(DNA)

(SEQ ID NO: 1660)

atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaacagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcggagggaccaaggtggagatcaaacgaacaacaacccctgccccagacctcctaccccagcccta caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat cacccttactgcaaacggggcagaaagaaactcctgtatatattcaaacaaccatttatgagaccagtacaaacta ctcaagaggaagatggctgtagctgccgatttccagaagaagaagaaggaggatgtgaactgagagtgaagttcagc aggagcgcagacgcccccgcgtacaagcagggccagaaccagctctataacgagctcaatctaggacgaagagagga gtacgatgtttttggacaagagacgtggccgggaccctgagatggggggaaagccgagaaggaagaaccctcaggaag gcctgtacaatgaactgcagaaagataagatggcggaggcctacagtgagattgggatgaaaggcgagcgccggagg ggcaaggggcacgatggcctttaccagggtctcagtacagccaccaaggacacctacgacgcccttcacatgcaggc cctgccccctcgctgataagtttaaactgccagaacatttctctggcctaactggccggtaccggcttcatttttc catttactgcagaggcttcatttttccatttactgcagaggcttcatttttccatttactgcagaactagttagg cgtgtacggtgggaggcctatataagcagagctcgtttagtgaaccgtcagatcgcctggagacgccatccacgctg ttttgacctccatagaagacaccgggaccgatccagcctcgagagacccaatgctagccaccatggccttaccagtg accgccttgctcctgccgctggccttgctgctccacgccgccaggccgtacttcggcaagctggaaagcaagctgag cgtgatccggaacctgaacgaccaggtgctgttcatcgatcagggcaacagacccctgttcgaggacatgaccgaca gcgactgcagagacaacgcccctcggaccatcttcatcatcagcatgtacaaggacagccagcctagaggcatggcc gtgaccatctctgtgaagtgcgagaagatcagcaccctgagctgcgagaacaagatcatcagcttcaaagagatgaa cccgccggacaacatcaaggacaccaagagcgacatcatattcttccagcggagcgtgcccggccacgacaacaaga tgcagtttgagagcagcagctacgagggctacttcctggcctgcgagaaagagcgggacctgttcaagctgatcctg aagaaagaggacgaactgggcgaccgcagcatcatgttcaccgtgcagaacgaggactgataa mu20A10-8-28-3z-Foxp3-NFAT-IL-18
(DNA)

(SEQ ID NO: 1661)

atggccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa -continued gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaaccctgcccccagacctcctaccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtgggtccttctcctgtcactggttatcac cctttactgcaggagtaagaggagcaggctcctgcacagtgactacatgaacatgactcctagaagacctgggccta ccagaaagcattaccagccctatgccccaccacgcgacttcgcagcctatcgctccagagtgaagttcagcaggagc gcagacgcccccgcgtacaagcagggccagaaccagctctataacgagctcaatctaggacgaagagaggagtacga tgttttggacaagagacgtggcgggaccctgagatggggggaaagccgagaaggaagaaccctcaggaaggcctgt acaatgaactgcagaaagataagatggcgggaggcctacagtgagattgggatgaaaggcgagcgccggaggggcaag gggcacgatggcctttaccagggtctcagtacagccaccaaggacacctacgacgcccttcacatgcaggccctgcc ccctcgctgataagtttaaactgccagaacatttctctggcctaactggccggtaccggcttcattttttccattta ctgcagaggcttcattttttccatttactgcagaggcttcattttttccatttactgcagaactagttaggcgtgta cggtgggaggcctatataagcagagctcgtttagtgaaccgtcagatcgcctggagacgccatccacgctgtttttga cctccatagaagacaccgggaccgatccagcctcgagagacccaatgctagccaccatggccttaccagtgaccgcc ttcgtcctgccgctggccttgctgctccacgccgccaggccgtacttcggcaagctggaaagcaagctgagcgtgat cgggaacctgaacgaccaggtgctgttcatcgatcagggcaacagacccctgttcgaggacatgaccgacagcgact gcagagacaacgcccctcggaccatcttcatcatcagcatgtacaaggacagccagcctagaggcatggccgtgacc atctctgtgaagtgcgagaagatcagcaccctgagctgcgagaacaagatcatcagcttcaaagagatgaacccgcc ggacaacatcaaggacaccaagagcgacatcatattcttccagcggagcgtgcccggccacgacaacaagatgcagt ttgagcagcagctacgagggctacttcctggcctgcgagaaagagcgggacctgttcaagctgatcctgaagaaa gaggacgaactgggcgaccgcagcatcatgttcaccgtgcagaacgaggactgataa hu20A10-8-28-3z-Foxp3-NFAT-IL-18
(DNA)

(SEQ ID NO: 1662)

atggcccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcggagggaccaaggtggagatcaaacgaacaacaacccctgcccccagacctcctaccccagcccta caattgccagccagcctctgagcctgaggcccgaggcttgtagacctgctgctggcggagccgtgcacaccagagga ctggatttcgcctgcgacatctacatctgggcgcccttggccgggacttgtgggtccttctcctgtcactggttat caccctttactgcaggagtaagaggagcaggctcctgcacagtgactacatgaacatgactcctagaagacctgggc ctaccagaaagcattaccagccctatgccccaccacgcgacttcgcagcctatcgctccagagtgaagttcagcagg agcgcagacgcccccgcgtacaagcagggccagaaccagctctataacgagctcaatctaggacgaagagaggagta -continued

```
cgatgttttggacaagagacgtggccgggaccctgagatggggggaaagccgagaaggaagaaccctcaggaaggcc tgtacaatgaactgcagaaagataagatggcggaggcctacagtgagattggggatgaaaggcgagcgccggaggggc aaggggcacgatggcctttaccagggtctcagtacagccaccaaggacacctacgacgcccttcacatgcaggccct gcccctcgctgataagtttaaactgccagaacatttctctggcctaactggccggtaccggcttcattttttccat ttactgcagaggcttcattttttccatttactgcagaggcttcatttttccatttactgcagaactagttaggcgt gtacggtgggaggcctatataagcagagctcgtttagtgaaccgtcagatcgcctggagacgccatccacgctgttt tgacctccatagaagacaccgggaccgatccagcctcgagagacccaatgctagccaccatggccttaccagtgacc gccttgctcctgccgctggccttgctgctccacgccgccaggccgtacttcggcaagctggaaagcaagctgagcgt gatccggaacctgaacgaccaggtgctgttcatcgatcagggcaacagacccctgttcgaggacatgaccgacagcg actgcagagacaacgcccctcggaccatcttcatcatcagcatgtacaaggacagccagcctagaggcatggccgtg accatctctgtgaagtgcgagaagatcagcaccctgagctgcgagaacaagatcatcagcttcaaagagatgaaccc gccggacaacatcaaggacaccaagagcgacatcatattcttccagcggagcgtgcccggccacgacaacaagatgc agtttgagagcagcagctacgagggctacttcctggcctgcgagaaagagcgggacctgttcaagctgatcctgaag aaagaggacgaactgggcgaccgcagcatcatgttcaccgtgcagaacgaggactgataa
``` mu20A10-8-4-1BB-3z1XX-Foxp3-NFAT-IL-18
(DNA)

(SEQ ID NO: 1663)

```
atggcccttaccagtgaccgccttgctcctgccgctggccttgctgctccacgccgccaggccggaagtgatgctggt ggaatctggcggcggactggttaagcctggcggatctctgaagctgagctgtgccgccagcggcttcacctttagca catacgccatgagctggatccggcagacccctgagaagagactggaatgggttgccagcatcggcagagccggcagc acctactacagcgattctgtgaagggcagattcaccatcagccgggacaacgtgcggaacatcctgtacctgcagat gagcagcctgcggagcgaggataccgccatgtactactgtgccagaggaccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaacccctgcccccagacctcctaccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtggggtccttctcctgtcactggttatcac cctttactgcaaacggggcagaaagaaactcctgtatatattcaaacaaccatttatgagaccagtacaaactactc aagaggaagatggctgtagctgccgatttccagaagaagaagaaggaggatgtgaactgagagtgaagttcagcagg agcgcagacgcccccgcgtacaagcagggccagaaccagctctataacgagctcaatctaggacgaagagaggagta cgatgttttggacaagagacgtggccgggaccctgagatggggggaaagccgagaaggaagaaccctcaggaaggcc tgttcaatgaactgcagaaagataagatggcggaggccttcagtgagattgggatgaaaggcgagcgccggaggggc aaggggcacgatggccttttccagggtctcagtacagccaccaaggacaccttcgacgcccttcacatgcaggccct gcccctcgctgataagtttaaactgccagaacatttctctggcctaactggccggtaccggcttcattttttccat ttactgcagaggcttcattttttccatttactgcagaggcttcatttttccatttactgcagaactagttaggcgt gtacggtgggaggcctatataagcagagctcgtttagtgaaccgtcagatcgcctggagacgccatccacgctgttt tgacctccatagaagacaccgggaccgatccagcctcgagagacccaatgctagccaccatggccttaccagtgacc gccttgctcctgccgctggccttgctgctccacgccgccaggccgtacttcggcaagctggaaagcaagctgagcgt gatccggaacctgaacgaccaggtgctgttcatcgatcagggcaacagacccctgttcgaggacatgaccgacagcg
```

-continued

```
actgcagagacaacgcccctcggaccatcttcatcatcagcatgtacaaggacagccagcctagaggcatggccgtg accatctctgtgaagtgcgagaagatcagcaccctgagctgcgagaacaagatcatcagcttcaaagagatgaaccc gccggacaacatcaaggacaccaagagcgacatcatattcttccagcggagcgtgcccggccacgacaacaagatgc agtttgagagcagcagctacgagggctacttcctggcctgcgagaaagagcgggacctgttcaagctgatcctgaag aaagaggacgaactgggcgaccgcagcatcatgttcaccgtgcagaacgaggactgataa
``` hu20A10-8-4-1BB-3z1XX-Foxp3-NFAT-IL-18
(DNA)

(SEQ ID NO: 1664)

```
atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcggagggaccaaggtggagatcaaacgaacaacaaccccctgcccccagacctcctaccccagccccta caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat cacccttttactgcaaacggggcagaaagaaactcctgtatatattcaaacaaccatttatgagaccagtacaaacta ctcaagaggaagatggctgtagctgccgatttccagaagaagaagaaggaggatgtgaactgagagtgaagttcagc aggagcgcagacgcccccgcgtacaagcagggccagaaccagctctataacgagctcaatctaggacgaagagagga gtacgatgtttttggacaagagacgtggccgggaccctgagatggggggaaagccgagaaggaagaaccctcaggaag gcctgttcaatgaactgcagaaagataagatggcggaggccttcagtgagattgggatgaaaggcgagcgccggagg ggcaaggggcacgatggcctttttccagggtctcagtacagccaccaaggacaccttcgacgcccttcacatgcaggc cctgccccctcgctgataagtttaaactgccagaacatttctctggcctaactggccggtaccggcttcatttttttc catttactgcagaggcttcatttttttccatttactgcagaggcttcatttttttccatttactgcagaactagttagg cgtgtacggtgggaggcctatataagcagagctcgtttagtgaaccgtcagatcgcctggagacgccatccacgctg ttttgacctccatagaagacaccgggaccgatccagcctcgagagacccaatgctagccaccatggccttaccagtg accgccttgctcctgccgctggccttgctgctccacgccgccaggccgtacttcggcaagctggaaagcaagctgag cgtgatccggaacctgaacgaccaggtgctgttcatcgatcaggcaacagacccctgttcgaggacatgaccgaca gcgactgcagagacaacgcccctcggaccatcttcatcatcagcatgtacaaggacagccagcctagaggcatggcc gtgaccatctctgtgaagtgcgagaagatcagcaccctgagctgcgagaacaagatcatcagcttcaaagagatgaa cccgcggacaacatcaaggacaccaagagcgacatcatattcttccagcggagcgtgcccggccacgacaacaaga tgcagtttgagagcagcagctacgagggctacttcctggcctgcgagaaagagcgggacctgttcaagctgatcctg aagaaagaggacgaactgggcgaccgcagcatcatgttcaccgtgcagaacgaggactgataa
``` mu20A10-8-28-3z1XX-Foxp3-NFAT-IL-18
(DNA)

(SEQ ID NO: 1665)

```
atggccttaccagtgaccgccttgctcctgccgctggccttgctgctccacgccgccaggccggaagtgatgctggt ggaatctggcggcggactggttaagcctggcggatctctgagctgagctgtgccgccagcggcttcacctttagca catacgccatgagctggatccggcagacccctgagaagagactggaatgggttgccagcatcggcagagccggcagc
``` acctactacagcgattctgtgaagggcagattcaccatcagccgggacaacgtgcggaacatcctgtacctgcagat gagcagcctgcggagcgaggataccgccatgtactactgtgccagaggacccatctacaacgactacgacgagttcg cctattggggccagggcacactggttacagtttctgctggtggcggaggatctggcggaggtggaagcggcggaggc ggatccaatatcatgatgacacagagcccgagcagcctggctgtgtctgctggcgagaaagtgaccatgtcctgcaa gagcagccagagcgtgctgtactccagcaaccagaagaactacctggcctggtatcagcagaagcccggccagtctc ctaagctgctgatctactgggccagcaccagagaaagcggcgtgcccgatagattcacaggcagcggcagcggaacc gacttcaccctgacaatcagctctgtgcaggccgaagatctggccgtgtactattgccaccagtacctgtccagcct gacctttggcgccggaacaaagctggaactgaagacaacaaccctgccccagacctcctaccccagcccctacaa ttgccagccagcctctgagcctgaggcccgaggcttgtagacctgctgctggcggagccgtgcacaccagaggactg gatttcgcctgcgacatctacatctgggcgcccttggccgggacttgtggggtccttctcctgtcactggttatcac cctttactgcaggagtaagaggagcaggctcctgcacagtgactacatgaacatgactcctagaagacctgggccta ccagaaagcattaccagccctatgcccaccacgcgacttcgcagcctatcgctccagagtgaagttcagcaggagc gcagacgccccgcgtacaagcagggccagaaccagctctataacgagctcaatctaggacgaagagaggagtacga tgtttggacaagagacgtggccgggaccctgagatggggggaaagccgagaaggaagaaccctcaggaaggcctgt tcaatgaactgcagaaagataagatggcggaggccttcagtgagattgggatgaaaggcgagcgccggaggggcaag gggcacgatggcctttttccagggtctcagtacagccaccaaggacaccttcgacgcccttcacatgcaggccctgcc ccctcgctgataagtttaaactgccagaacatttctctggcctaactggccggtaccggcttcatttttttccattta ctgcagaggcttcatttttttccatttactgcagaggcttcatttttttccatttactgcagaactagttaggcgtgta cggtgggaggcctatataagcagagctcgtttagtgaaccgtcagatcgcctggagacgccatccacgctgttttga cctccatagaagacaccgggaccgatccagcctcgagagacccaatgctagccaccatggccttaccagtgaccgcc ttgctcctgccgctggccttgctgctccacgccgccaggccgtacttcggcaagctggaaagcaagctgagcgtgat ccggaacctgaacgaccaggtgctgttcatcgatcagggcaacagacccctgttcgaggacatgaccgacagcgact gcagagacaacgcccctcggaccatcttcatcatcagcatgtacaaggacagccagcctagaggcatggccgtgacc atctctgtgaagtgcgagaagatcagcaccctgagctgcgagaacaagatcatcagcttcaaagagatgaacccgcc ggacaacatcaaggacaccaagagcgacatcatattcttccagcggagcgtgcccggccacgacaacaagatgcagt ttgagagcagcagctacgagggctacttcctggcctgcgagaaagagcgggacctgttcaagctgatcctgaagaaa gaggacgaactgggcgaccgcagcatcatgttcaccgtgcagaacgaggactgataa hu20A10-8-28-3z1XX-Foxp3-NFAT-IL-18
(DNA)

(SEQ ID NO: 1666)
atggcccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacattgtgctgacccagtctccagcctccttggccgtgtctccaggacagagggccaccatcacctgcaa gagcagccagagcgtgctgtactccagcaaccagaagaactacctggcctggtatcagcagaaaccaggacaacctc ctaaactcctgatttactgggccagcaccagagaaagcggggtcccagccaggttcagcggcagtgggtctgggacc gatttcaccctcacaattaatcctgtggaagctaatgatactgcaaattattactgtcaccagtacctgagcagcct gaccttcggcgcgagggaccaaggtggagatcaaacgaacaacaacccctgccccagacctcctaccccagccccta caattgccagccagcctctgagcctgaggcccgaggcttgtagacctgctgctggcggagccgtgcacaccagagga -continued

```
ctggatttcgcctgcgacatctacatctgggcgcccttggccgggacttgtggggtccttctcctgtcactggttat cacccctttactgcaggagtaagaggagcaggctcctgcacagtgactacatgaacatgactcctagaagacctgggc ctaccagaaagcattaccagccctatgccccaccacgcgacttcgcagcctatcgctccagagtgaagttcagcagg agcgcagacgcccccgcgtacaagcagggccagaaccagctctataacgagctcaatctaggacgaagagaggagta cgatgttttggacaagagacgtggccgggaccctgagatggggggaaagccgagaaggaagaaccctcaggaaggcc tgttcaatgaactgcagaaagataagatggcggaggccttcagtgagattgggatgaaaggcgagcgccggaggggc aaggggcacgatggccttttccagggtctcagtacagccaccaaggacaccttcgacgcccttcacatgcaggccct gcccctcgctgataagtttaaactgccagaacatttctctggcctaactggccggtaccggcttcattttttccat ttactgcagaggcttcattttttccatttactgcagaggcttcatttttttccatttactgcagaactagttaggcgt gtacggtgggaggcctatataagcagagctcgtttagtgaaccgtcagatcgcctggagacgccatccacgctgttt tgacctccatagaagacaccgggaccgatccagcctcgagagacccaatgctagccaccatggccttaccagtgacc gccttgctcctgccgctggccttgctgctccacgccgccaggccgtacttcggcaagctggaaagcaagctgagcgt gatccggaacctgaacgaccaggtgctgttcatcgatcagggcaacagacccctgttcgaggacatgaccgacagcg actgcagagacaacgcccctcggaccatcttcatcatcagcatgtacaaggacagccagcctagaggcatggccgtg accatctctgtgaagtgcgagaagatcagcaccctgagctgcgagaacaagatcatcagcttcaaagagatgaaccc gccggacaacatcaaggacaccaagagcgacatcatattcttccagcggagcgtgcccggccacgacaacaagatgc agtttgagagcagcagctacgagggctacttcctggcctgcgagaaagagcgggacctgttcaagctgatcctgaag aaagaggacgaactgggcgaccgcagcatcatgttcaccgtgcagaacgaggactgataa
```

25E6
mu25E6-8-4-1EE-3z-Foxp3-NFAT-IL-18
(DNA)

(SEQ ID NO: 1667)

```
atggccttaccagtgaccgccttgctcctgccgctggccttgctgctccacgccgccaggccggaggtgcagctggt ggagtctggggggagacttagtgaagcctggagggtccctgaaactctcctgtgcagcctctggtttcactttcagta gttatggaatgtcttgggttcgccagactccagacaagaggctggagtgggtcgcaaccattagtaatggtggtaga cacaccttctatccagacagtgtgaaggggcgattcaccatctccagagacaatgccaagaacaccctgtatctgca aatgagcagtctgaagtctgaggacacagccatgtatttatgtgtaagacagactgggacgggagggctggtttgctt actggggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaaccctgcccccagacctcctaccccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt acaatgaactgcagaaagataagatggcggaggcctacagtgagattgggatgaaaggcgagcgccggaggggcaag gggcacgatggcctttaccagggtctcagtacagccaccaaggacacctacgacgcccttcacatgcaggccctgcc ccctcgctgataagtttaaactgccagaacatttctctggcctaactggccggtaccggcttcattttttccattta
```

-continued ctgcagaggcttcatttttttccatttactgcagaggcttcatttttttccatttactgcagaactagttaggcgtgta cggtgggaggcctatataagcagagctcgtttagtgaaccgtcagatcgcctggagacgccatccacgctgttttga cctccatagaagacaccgggaccgatccagcctcgagagacccaatgctagccaccatggccttaccagtgaccgcc ttgctcctgccgctggccttgctgctccacgccgccaggccgtacttcggcaagctggaaagcaagctgagcgtgat ccggaacctgaacgaccaggtgctgttcatcgatcagggcaacagacccctgttcgaggacatgaccgacagcgact gcagagacaacgcccctcggaccatcttcatcatcagcatgtacaaggacagccagcctagaggcatggccgtgacc atctctgtgaagtgcgagaagatcagcaccctgagctgcgagaacaagatcatcagcttcaaagagatgaacccgcc ggacaacatcaaggacaccaagagcgacatcatattcttccagcggagcgtgcccggccacgacaacaagatgcagt ttgagagcagcagctacgagggctacttcctggcctgcgagaaagagcgggacctgttcaagctgatcctgaagaaa gaggacgaactgggcgaccgcagcatcatgttcaccgtgcagaacgaggactgataa hu25E6-8-4-1EE-3z-Foxp3-NFAT-IL-18
(DNA)

(SEQ ID NO: 1668)

atggccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actggggccagggcaccctggtgaccgtgtccagcggcggtggcggaagcggaggcggtggctccggtggcggaggc agcgacatcgtgatgacccagacccctctgtctctgagcgtgacccctggccagcctgccagcatctcttgtaaaag cagccagagctgctggacagcgacggcaagacctacctgaactggtacctgcagaagcccggccaaagccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaacccctgccccagacctcctaccccagcccctacaattg ccagccagctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgtttggacaagagacgtggcgggaccctgagatggggggaaagccgagaaggaagaaccctcaggaaggcctgt acaatgaactgcagaaagataagatggcggaggcctacagtgagattgggatgaaaggcgagcgccggaggggcaag gggcacgatggcctttaccagggtctcagtacagccaccaaggacacctacgacgcccttcacatgcaggccctgcc ccctcgtgataagtttaaactgccagaacatttctctggcctaactggccggtaccggcttcatttttttccatttta ctgcagaggcttcatttttttccatttactgcagaggcttcatttttttccatttactgcagaactagttaggcgtgta cggtgggaggcctatataagcagagctcgtttagtgaaccgtcagatcgcctggagacgccatccacgctgttttga cctccatagaagacaccgggaccgatccagcctcgagagacccaatgctagccaccatggccttaccagtgaccgcc ttgctcctgccgctggccttgctgctccacgccgccaggccgtacttcggcaagctggaaagcaagctgagcgtgat ccggaacctgaacgaccaggtgctgttcatcgatcagggcaacagacccctgttcgaggacatgaccgacagcgact gcagagacaacgcccctcggaccatcttcatcatcagcatgtacaaggacagccagcctagaggcatggccgtgacc atctctgtgaagtgcgagaagatcagcaccctgagctgcgagaacaagatcatcagcttcaaagagatgaacccgcc ggacaacatcaaggacaccaagagcgacatcatattcttccagcggagcgtgcccggccacgacaacaagatgcagt -continued ttgagagcagcagctacgagggctacttcctggcctgcgagaaagagcgggacctgttcaagctgatcctgaagaaa gaggacgaactgggcgaccgcagcatcatgttcaccgtgcagaacgaggactgataa mu25E6-8-28-3z-Foxp3-NFAT-IL-18
(DNA)

(SEQ ID NO: 1669)

atggccttaccagtgaccgccttgctcctgccgctggccttgctgctccacgccgccaggccggaggtgcagctggt ggagtctgggggagacttagtgaagcctggagggtccctgaaactctcctgtgcagcctctggttttcactttcagta gttatggaatgtcttgggttcgccagactccagacaagaggctggagtgggtcgcaaccattagtaatggtggtaga cacaccttctatccagacagtgtgaaggggcgattcaccatctccagagacaatgccaagaacaccctgtatctgca aatgagcagtctgaagtctgaggacacagccatgtatttatgtgtaagacagactgggacggagggctggtttgctt actggggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaacccctgcccccagacctcctaccccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgccccaccacgcgacttcgcagcctatcgctccagagtgaagttcagcaggagcgca gacgcccccgcgtacaagcagggccagaaccagctctataacgagctcaatctaggacgaagagaggagtacgatgt tttggacaagagacgtggccgggaccctgagatggggggaaagccgagaaggaagaaccctcaggaaggcctgtaca atgaactgcagaaagataagatggcggaggcctacagtgagattgggatgaaaggcgagcgccggaggggcaagggg cacgatggcctttaccagggtctcagtacagccaccaaggacacctacgacgcccttcacatgcaggccctgcccccc tcgctgataagtttaaactgccagaacatttctctggcctaactggccggtaccggcttcatttttttccatttactg cagaggcttcatttttttccatttactgcagaggcttcatttttttccatttactgcagaactagttaggcgtgtacgg tgggaggcctatataagcagagctcgtttagtgaaccgtcagatcgcctggagacgccatccacgctgttttgacct ccatagaagacaccgggaccgatccagcctcgagagacccaatgctagccaccatggccttaccagtgaccgccttg ctcctgccgctggccttgctgctccacgccgccaggccgtacttcggcaagctggaaagcaagctgagcgtgatccg gaacctgaacgaccaggtgctgttcatcgatcagggcaacagacccctgttcgaggacatgaccgacagcgactgca gagacaacgcccctcggaccatcttcatcatcagcatgtacaaggacagccagcctagaggcatggccgtgaccatc tctgtgaagtgcgagaagatcagcaccctgagctgcgagaacaagatcatcagcttcaaagagatgaacccgccgga caacatcaaggacaccaagagcgacatcatattcttccagcggagcgtgcccggccacgacaacaagatgcagtttg agagcagcagctacgagggctacttcctggcctgcgagaaagagcgggacctgttcaagctgatcctgaagaaagag gacgaactgggcgaccgcagcatcatgttcaccgtgcagaacgaggactgataa hu25E6-8-28-3z-Foxp3-NFAT-IL-18
(DNA)

(SEQ ID NO: 1670)

atggccttaccagtgaccgccttgctcctgccgctggccttgctgctccacgccgccaggccggaggtgcagctggt ggaatctggcgcgaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct -continued

```
actggggccagggcaccctggtgaccgtgtccagcggcggtggcggaagcggaggcggtggctccggtggcggaggc agcgacatcgtgatgacccagacccctctgtctctgagcgtgacccctggccagcctgccagcatctcttgtaaaag cagccagagcctgctggacagcgacggcaagacctacctgaactggtacctgcagaagcccggccaaagccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaacccctgcccccagacctcctaccccagccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgccccaccacgcgacttcgcagcctatcgctccagagtgaagttcagcaggagcgca gacgcccccgcgtacaagcagggccagaaccagtctataacgagctcaatctaggacgaagagaggagtacgatgt tttggacaagagacgtggcgggaccctgagatggggggaaagccgagaaggaagaaccctcaggaaggcctgtaca atgaactgcagaaagataagatggcggaggcctacagtgagattgggatgaaaggcgagcgccggaggggcaagggg cacgatggcctttaccagggtctcagtacagccaccaaggacacctacgacgcccttcacatgcaggccctgccccc tcgctgataagtttaaactgccagaacatttctctggcctaactggccggtaccggcttcatttttttccatttactg cagaggcttcatttttttccatttactgcagaggcttcatttttttccatttactgcagaactagttaggcgtgtacgg tgggaggcctatataagcagagctcgtttagtgaaccgtcagatcgcctggagacgccatccacgctgttttgacct ccatagaagacacggggaccgatccagcctcgagagacccaatgctagccaccatggccttaccagtgaccgccttg ctcctgccgctggccttgctgctccacgccgccaggccgtacttcggcaagctggaaagcaagctgagcgtgatccg gaacctgaacgaccaggtgtgttcatcgatcagggcaacagacccctgttcgaggacatgaccgacagcgactgca gagacaacgcccctggaccatcttcatcatcagcatgtacaaggacagccagcctagaggcatggccgtgaccatc tctgtgaagtgcgagaagatcagcaccctgagctgcgagaacaagatcatcagcttcaaagagatgaacccgccgga caacatcaaggacaccaagagcgacatcatattcttccagcggagcgtgcccggccacgacaacaagatgcagtttg agagcagcagctacgagggctacttcctggcctgcgagaaagagcgggacctgttcaagctgatcctgaagaaagag gacgaactgggcgaccgcagcatcatgttcaccgtgcagaacgaggactgataa
``` mu25E6-8-4-11313-3z1XX-Foxp3-NFAT-IL-18
(DNA)

(SEQ ID NO: 1671)
```
atggccttaccagtgaccgcctttgctcctgccgctggccttgctgctccacgccgccaggccggaggtgcagctggt ggagtctgggggagacttagtgaagcctggagggtccctgaaactctcctgtgcagcctctggtttcactttcagta gttatggaatgtcttgggttcgccagactccagacaagaggctggagtgggtcgcaaccattagtaatggtggtaga cacaccttctatccagacagtgtgaaggggcgattcaccatctccagagacaatgccaagaacaccctgtatctgca aatgagcagtctgaagtctgaggacacagccatgtatttatgtgtaagacagactgggacggagggctggtttgctt actggggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaacccctgcccccagacctcctaccccagccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag
```

-continued aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt tcaatgaactgcagaaagataagatggcggaggccttcagtgagattgggatgaaaggcgagcgccggagggggcaag gggcacgatggcctttttccagggtctcagtacagccaccaaggacaccttcgacgcccttcacatgcaggccctgcc ccctcgctgataagtttaaactgccagaacatttctctggcctaactggccggtaccggcttcatttttttccattta ctgcagaggcttcatttttttccatttactgcagaggcttcatttttttccatttactgcagaactagttaggcgtgta cggtgggaggcctatataagcagagctcgtttagtgaaccgtcagatcgcctggagacgccatccacgctgttttga cctccatagaagacaccgggaccgatccagcctcgagagacccaatgctagccaccatggccttaccagtgaccgcc ttgtcctgccgctggccttgctgctccacgccgccaggccgtacttcggcaagctggaaagcaagctgagcgtgat cggaacctgaacgaccaggtgctgttcatcgatcagggcaacagacccctgttcgaggacatgaccgacagcgact gcagagacaacgcccctcggaccatcttcatcatcagcatgtacaaggacagccagcctagaggcatggccgtgacc atctctgtgaagtgcgagaagatcagcaccctgagctgcgagaacaagatcatcagcttcaaagagatgaacccgcc ggacaacatcaaggacaccaagagcgacatcatattcttccagcggagcgtgcccggccacgacaacaagatgcagt ttgagagcagcagctacgagggctacttcctggcctgcgagaaagagcgggacctgttcaagctgatcctgaagaaa gaggacgaactgggcgaccgcagcatcatgttcaccgtgcagaacgaggactgataa hu25E6-8-4-11313-3z1XX-Foxp3-NFAT-IL-18
(DNA)

(SEQ ID NO: 1672)

atggccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actggggccagggcaccctggtgaccgtgtccagcggcggtggcggaagcggaggcggtggctccggtggcggaggc agcgacatcgtgatgacccagacccctctgtctctgagcgtgacccctggccagcctgccagcatctcttgtaaaag cagccagagcctgctggacagcgacggcaagacctacctgaactggtacctgcagaagcccggccaaagcccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaacccctgcccccagacctcctaccccagccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaaacggggcagaaagaaactcctgtatatattcaaacaaccatttatgagaccagtacaaactactcaag aggaagatggctgtagctgccgatttccagaagaagaagaaggaggatgtgaactgagagtgaagttcagcaggagc gcagacgcccccgcgtacaagcagggccagaaccagctctataacgagctcaatctaggacgaagagaggagtacga tgttttggacaagagacgtggccgggaccctgagatggggggaaagccgagaaggaagaaccctcaggaaggcctgt tcaatgaactgcagaaagataagatggcggaggccttcagtgagattgggatgaaaggcgagcgccggagggggcaag gggcacgatggcctttttccagggtctcagtacagccaccaaggacaccttcgacgcccttcacatgcaggccctgcc ccctcgctgataagtttaaactgccagaacatttctctggcctaactggccggtaccggcttcatttttttccattta ctgcagaggcttcatttttttccatttactgcagaggcttcatttttttccatttactgcagaactagttaggcgtgta cggtgggaggcctatataagcagagctcgtttagtgaaccgtcagatcgcctggagacgccatccacgctgttttga cctccatagaagacaccgggaccgatccagcctcgagagacccaatgctagccaccatggccttaccagtgaccgcc -continued

```
ttgctcctgccgctggccttgctgctccacgccgccaggccgtacttcggcaagctggaaagcaagctgagcgtgat ccggaacctgaacgaccaggtgctgttcatcgatcagggcaacagacccctgttcgaggacatgaccgacagcgact gcagagacaacgcccctcggaccatcttcatcatcagcatgtacaaggacagccagcctagaggcatggccgtgacc atctctgtgaagtgcgagaagatcagcaccctgagctgcgagaacaagatcatcagcttcaaagagatgaacccgcc ggacaacatcaaggacaccaagagcgacatcatattcttccagcggagcgtgcccggccacgacaacaagatgcagt ttgagagcagcagctacgagggctacttcctggcctgcgagaaagagcgggacctgttcaagctgatcctgaagaaa gaggacgaactgggcgaccgcagcatcatgttcaccgtgcagaacgaggactgataa
``` mu25E6-8-28-3z1XX-Foxp3-NFAT-IL-18
(DNA)

(SEQ ID NO: 1673)

```
atggcccttaccagtgaccgccttgctcctgccgctggccttgctgctccacgccgccaggccggaggtgcagctggt ggagtctggggggagacttagtgaagcctggagggtccctgaaactctcctgtgcagcctctggtttcactttcagta gttatggaatgtcttggggttcgccagactccagacaagaggctggagtgggtcgcaaccattagtaatggtggtaga cacaccttctatccagacagtgtgaaggggcgattcaccatctccagagacaatgccaagaacaccctgtatctgca aatgagcagtctgaagtctgaggacacagccatgtatttatgtgtaagacagactgggacggagggctggtttgctt actgggccaagggactctggtcactgtctctgcaggtggcggaggatctggcggaggtggaagcggcggaggcgga tccgatgttgtgatgacccagactccactcactttgtcggttaccattggacaaccagcctccatctcttgcaagtc aagtcagagcctcttagatagtgatggaaagacatatttgaattggttgttacagaggccaggccagtctccaaagc gcctaatctatctggtgtctaaactggactctggagtccctgacaggttcactggcagtggatcagggacagatttc acactgaaaatcagcagagtggaggctgaggatttgggagtttattattgctggcaaggtacacattttcctcagac gttcggtggaggcaccaagctggaaatcaaaacaacaaccctgcccccagacctcctaccccagccctacaattg ccagccagcctctgagcctgaggcccgaggcttgtagacctgctgctggcggagccgtgcacaccagaggactggat ttcgctgcgacatctacatctgggcgcccttggccgggacttgtgggtccttctcctgtcactggttatcaccct ttactgcaggagtaagaggagcaggctcctgcacagtgactacatgaacatgactcctagaagacctgggcctacca gaaagcattaccagccctatgccccaccacgcgacttcgcagcctatcgctccagagtgaagttcagcaggagcgca gacgcccccgcgtacaagcagggccagaaccagtctataacgagctcaatctaggacgaagagaggagtacgatgt tttggacaagagacgtggcgggacccctgagatggggggaaagccgagaaggaagaaccctcaggaaggcctgttca atgaactgcagaaagataagatggcggaggccttcagtgagattgggatgaaaggcgagcgccggaggggcaagggg cacgatggccttttccagggtctcagtacagccaccaaggacaccttcgacgcccttcacatgcaggccctgcccccc tcgctgataagtttaaactgccagaacatttctctggcctaactggccggtaccggcttcatttttttccatttactg cagaggcttcatttttttccatttactgcagaggcttcatttttttccatttactgcagaactagttaggcgtgtacgg tgggaggcctatataagcagagctcgtttagtgaaccgtcagatcgcctggagacgccatccacgctgtttttgacct ccatagaagacaccgggaccgatccagcctcgagagacccaatgctagccaccatggccttaccagtgaccgccttg ctcctgccgctggccttgctgctccacgccgccaggccgtacttcggcaagctggaaagcaagctgagcgtgatccg gaacctgaacgaccaggtgctgttcatcgatcagggcaacagacccctgttcgaggacatgaccgacagcgactgca gagacaacgcccctcggaccatcttcatcatcagcatgtacaaggacagccagcctagaggcatggccgtgaccatc tctgtgaagtgcgagaagatcagcaccctgagctgcgagaacaagatcatcagcttcaaagagatgaacccgccgga caacatcaaggacaccaagagcgacatcatattcttccagcggagcgtgcccggccacgacaacaagatgcagtttg agagcagcagctacgagggctacttcctggcctgcgagaaagagcgggacctgttcaagctgatcctgaagaaagag gacgaactgggcgaccgcagcatcatgttcaccgtgcagaacgaggactgataa
```

-continued hu25E6-8-28-3z1XX-Foxp3-NFAT-IL-18
(DNA)

(SEQ ID NO: 1674)
atggccttaccagtgaccgccttgctcctgccgctggccttgctgctccacgccgccaggccggaggtgcagctggt ggaatctggcggaggactggtcaagcctggaggcagcctgagactgagctgcgccgccagcggcttcacattcagca gctacggcatgagctgggtgcggcaggcccctggcaagggcctggaatgggtcagcaccatcagcaacggcggaaga cacaccttctaccccgacagcgtgaagggcagattcaccatctcaagagataacgccaagaacagcctgtacctgca gatgaacagcctgcgggccgaggacaccgccgtgtactactgcgccagacagaccggcacagagggctggttcgcct actggggccagggcaccctggtgaccgtgtccagcggcggtggcggaagcggaggcggtggctccggtggcggaggc agcgacatcgtgatgacccagacccctctgtctctgagcgtgacccctggccagcctgccagcatctcttgtaaaag cagccagagcctgctggacagcgacggcaagacctacctgaactggtacctgcagaagcccggccaaagccctcagc tgctgatctacctggtgtccaagctggatagcggtgttcctgatagattcagcggatctggcagcggcaccgacttc accctgaagatcagcagagtggaagccgaggacgtgggcgtgtactactgctggcagggcacacacttcccccagac attcggccagggcaccaaggtggaaatcaagacaacaaccctgccccagacctcctacccagcccctacaattg ccagccagcctctgagcctgaggcccgaggcttgtagacctgctgctggcggagccgtgcacaccagaggactggat ttcgcctgcgacatctacatctgggcgcccttggccgggacttgtggggtccttctcctgtcactggttatcaccct ttactgcaggagtaagaggagcaggctcctgcacagtgactacatgaacatgactcctagaagacctgggcctacca gaaagcattaccagccctatgcccaccacgcgacttcgcagcctatcgctccagagtgaagttcagcaggagcgca gacgcccccgcgtacaagcagggccagaaccagctctataacgagctcaatctaggacgaagagaggagtacgatgt tttggacaagagacgtggccgggaccctgagatggggggaaagccgagaaggaagaaccctcaggaaggcctgttca atgaactgcagaaagataagatggcggaggccttcagtgagattgggatgaaaggcgagcgccggaggggcaagggg cacgatggccttttccagggtctcagtacagccaccaaggacaccttcgacgcccttcacatgcaggccctgcccc tcgctgataagtttaaactgccagaacatttctctggcctaactggccggtaccggcttcatttttccatttactg cagaggcttcatttttccatttactgcagaggcttcatttttccatttactgcagaactagttaggcgtgtacgg tgggaggcctatataagcagagctcgtttagtgaaccgtcagatcgcctggagacgccatccacgctgttttgacct ccatagaagacaccgggaccgatccagcctcgagagacccaatgctagccaccatggccttaccagtgaccgccttg ctcctgccgctggccttgctgctccacgccgccaggccgtacttcggcaagctggaaagcaagctgagcgtgatccg gaacctgaacgaccaggtgctgttcatcgatcagggcaacagacccctgttcgaggacatgaccgacagcgactgca gagacaacgcccctcggaccatcttcatcatcagcatgtacaaggacagccagcctagaggcatggccgtgaccatc tctgtgaagtgcgagaagatcagcaccctgagctgcgagaacaagatcatcagcttcaaagagatgaacccgccgga caacatcaaggacaccaagagcgacatcatattcttccagcggagcgtgcccggccacgacaacaagatgcagtttg agagcagcagctacgagggctacttcctggcctgcgagaaagagcgggacctgttcaagctgatcctgaagaaagag gacgaactgggcgaccgcagcatcatgttcaccgtgcagaacgaggactgataa Construct Name: pCDH MSCV h20A10-O CAR 41BB
Construct backbone: pCDH CMV MCS (SBI)
Promoter MSCV
Leader sequence: Human CD8 alpha (1-63)
scFv Name: Humanized 20A10-O (64-807)
Hinge region: Human CD8 alpha (808-942)
Transmembrane Domain: Human CD8 alpha (943-1014)
Costimulatory Domains: Human 41BB (101 -1140) and CD3 zeta (1141-1476)

(SEQ ID NO: 1675)
atggccttaccagtgaccgccttgctcctgccgctggccttgctgctccacgccgccaggccggaggtgcagctggt tgaatctggcggcggacttgtgaagcctggcggatctctgagactgagctgtgccgccagcggcttcacctttagca catacgccatgagctgggtccgacaggcccctggaaaaggccttgaatgggttgcctctatcggcagagccggcagc acctactacagcgattctgtgaagggcagattcaccatcagccgggacaacgccaagaacagcctgtacctgcagat gaactccctgagagccgaggacaccgccgtgtactattgtgccagaggacccatctacaacgactacgacgagttcg cctattggggccagggcacactggtcacagtcagctctggcggtggcggaagcggaggcggtggctccggtggcgga ggcagcgacatcgtgatgacacagagccctgatagcctggccgtgtctctgggagagagagccaccatcaactgcaa gagcagccagagcgtgctgtactccagcaaccagaagaactacctggcctggtatcagcagaagcccggccagcctc ctaagctgctgatctactgggccagcaccagagaaagcggcgtgcccgatagattttctggcagcggctctggcacc gacttcaccctgacaattagctccctgcaggccgaggatgtggccgtgtactactgtcaccagtacctgagcagcct gacctttggcggcggaacaaaggtggaaatcaagcgaacaacaacccctgcccccagacctcctaccccagcccctA caattgccagccagcctctgagcctgaggcccgaggcttgtagacctgctgctggcggagccgtgcacaccagagga ctggatttcgcctgcgacatctacatctgggcgcccttggccgggacttgtggggtccttctcctgtcactggttat cacccttttactgcaaacggggcagaaagaaactcctgtatatattcaaacaaccatttatgagaccagtacaaacta ctcaagaggaagatggctgtagctgccgatttccagaagaagaagaaggaggatgtgaactgagagtgaagttcagc aggagcgcagacgcccccgcgtacaagcagggccagaaccagctctataacgagctcaatctaggacgaagagagga gtacgatgtttttggacaagagacgtggccgggaccctgagatggggggaaagccgagaaggaagaaccctcaggaag gcctgtacaatgaactgcagaaagataagatggcggaggcctacagtgagattgggatgaaaggcgagcgccggagg ggcaaggggcacgatggcctttaccagggtctcagtacagccaccaaggacacctacgacgcccttcacatgcaggc cctgccccctcgctgataa CD8 leader sequence
                                                    (SEQ ID NO: 1676)
ATGGCCTTACCAGTGACCGCCTTGCTCCTGCCGCTGGCCTTGCTGCTCCACGCCGCCAGGCCG (SEQ ID NO:  1677)
GAGGTGCAGCTGGTTGAATCTGGCGGCGGACTTGTGAAGCCTGGCGGATCTCTGAGACTGAGCTGTGCCGCCAGCGG

CTTCACCTTTAGCACATACGCCATGAGCTGGGTCCGACAGGCCCCTGGAAAAGGCCTTGAATGGGTTGCCTCTATCG

GCAGAGCCGGCAGCACCTACTACAGCGATTCTGTGAAGGGCAGATTCACCATCAGCCGGGACAACGCCAAGAACAGC

CTGTACCTGCAGATGAACTCCCTGAGAGCCGAGGACACCGCCGTGTACTATTGTGCCAGAGGACCCATCTACAACGA

CTACGACGAGTTCGCCTATTGGGGCCAGGGCACACTGGTCACAGTCAGCTCTGGCGGTGGCGGAagcGGAGGCGGTG

GCtccGGTGGCGGAGGCagcGACATCGTGATGACACAGAGCCCTGATAGCCTGGCCGTGTCTCTGGGAGAGAGAGCC

ACCATCAACTGCAAGAGCAGCCAGAGCGTGCTGTACTCCAGCAACCAGAAGAACTACCTGGCCTGGTATCAGCAGAA

GCCCGGCCAGCCTCCTAAGCTGCTGATCTACTGGGCCAGCACCAGAGAAAGCGGCGTGCCCGATAGATTTTCTGGCA

GCGGCTCTGGCACCGACTTCACCCTGACAATTAGCTCCCTGCAGGCCGAGGATGTGGCCGTGTACTACTGTCACCAG

TACCTGAGCAGCCTGACCTTTGGCGGCGGAACAAAGGTGGAAATCAAGcga (SEQ ID NO: 1678)
ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC (SEQ ID NO: 656)
ATCTACATCTGGGCGCCCTTGGCCGGGACTTGTGGGGTCCTTCTCCTGTCACTGGTTATCACCCTTTACTGC (SEQ ID NO: 1683)
AAACGGGGCAGAAAGAAACTCCTGTATATATTCAAACAACCATTTATGAGACCAGTACAAACTACTCAAGAGGAAGA

TGGCTGTAGCTGCCGATTTCCAGAAGAAGAAGAAGGAGGATGTGAACTG

-continued (SEQ ID NO: 1684)

AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTACAATGAACTGCAGAAAGATAAGATGGCGGAGGCCTACAGTGAGATTGGGGATGAAA

GGCGAGCGCCGGAGGGGCAAGGGGCACGATGGCCTTTACCAGGGTCTCAGTACAGCCACCAAGGACACCTACGACGC

CCTTCACATGCAGGCCCTGCCCCCTCGCTGATAA

Construct Name: pCDH MSCV h20A10-N CAR 41BB
Construct backbone: pCDH CMV MCS (SBI)
Promoter MSCV
Leader sequence: Human CD8 alpha (1-63)
scFv Name: Humanized 20A10-N (64-807)
Hinge region: Human CD8 alpha (808-942)
Transmembrane Domain: Human CD8 alpha (943-1014)
Costimulatory Domains: Human 41BB (1015-1140) and CD3 zeta (1141-1476)

(SEQ ID NO: 1790)

ATGGCCTTACCAGTGACCGCCTTGCTCCTGCCGCTGGCCTTGCTGCTCCACGCCGCCAGGCCGCAGGTGCAGCTGGT

TGAATCTGGCGGCGGACTTGTGAAGCCTGGCGGATCTCTGAGACTGAGCTGTGCCGCCAGCGGCTTCACCTTTAGCA

CATACGCCATGAGCTGGATCAGACAGGCCCCTGGCAAAGGCCTGGAATGGGTGgcgTCTATTGGCAGAGCCGGCAGC

ACCTACTACAGCGACTCTGTGAAGGGCAGATTCACCATCAGCCGGGACAACGCCAAGAACAGCCTGTACCTGCAGAT

GAACTCCCTGAGAGCCGAGGACACCGCCGTGTACTATTGTGCCAGAGGACCCATCTACAACGACTACGACGAGTTCG

CCTATTGGGGCCAGGGCACACTGGTCACAGTTTCTAGCGGCGGTGGCGGAAgcGGAGGCGGTGGCtccGGTGGCGGA

GGCagcGAAATTGTGCTGACACAGAGCCCCGCCACACTGTCACTTTCTCCAGGCGAAAGAGCCACACTGAGCTGCAA

GAGCAGCCAGAGCGTGCTGTACTCCAGCAACCAGAAGAACTACCTGGCCTGGTATCAGCAGAAGCCCGGCCAAGCTC

CTCGGCTGCTGATCTATTGGGCCAGCACAAGAGAGAGCGGCATCCCTGCCAGATTTTCTGGCAGCGGCTCTGGCACC

GATTTCACCCTGACCATAAGCAGCCTGGAACCTGAGGACTTCGCCGTGTATTACTGCCACCAGTACCTGAGCAGCCT

GACCTTTGGCGGAGGCACCAAGGTGGAAATCAAGCGGACAACAACCCCTGCCCCCAGACCTCCTACCCCAGCCCCTA

CAATTGCCAGCCAGCCTCTGAGCCTGAGGCCCGAGGCTTGTAGACCTGCTGCTGGCGGAGCCGTGCACACCAGAGGA

CTGGATTTCGCCTGCGACATCTACATCTGGGCGCCCTTGGCCGGGACTTGTGGGGTCCTTCTCCTGTCACTGGTTAT

CACCCTTTACTGCAAACGGGGCAGAAAGAAACTCCTGTATATATTCAAACAACCATTTATGAGACCAGTACAAACTA

CTCAAGAGGAAGATGGCTGTAGCTGCCGATTTCCAGAAGAAGAAGAAGGAGGATGTGAACTGAGAGTGAAGTTCAGC

AGGAGCGCAGACGCCCCCGCGTACAAGCAGGGCCAGAACCAGCTCTATAACGAGCTCAATCTAGGACGAAGAGAGGA

GTACGATGTTTTGGACAAGAGACGTGGCCGGGACCCTGAGATGGGGGGAAAGCCGAGAAGGAAGAACCCTCAGGAAG

GCCTGTACAATGAACTGCAGAAAGATAAGATGGCGGAGGCCTACAGTGAGATTGGGATGAAAGGCGAGCGCCGGAGG

GGCAAGGGGCACGATGGCCTTTACCAGGGTCTCAGTACAGCCACCAAGGACACCTACGACGCCCTTCACATGCAGGC

CCTGCCCCCTCGCTGATAA

CD8 leader sequence (SEQ ID NO: 1679)

ATGGCCTTACCAGTGACCGCCTTGCTCCTGCCGCTGGCCTTGCTGCTCCACGCCGCCAGGCCG (SEQ ID NO: 1680)

CAGGTGCAGCTGGTTGAATCTGGCGGCGGACTTGTGAAGCCTGGCGGATCTCTGAGACTGAGCTGTGCCGCCAGCGG

CTTCACCTTTAGCACATACGCCATGAGCTGGATCAGACAGGCCCCTGGCAAAGGCCTGGAATGGGTGGgcgTCTATTG

GCAGAGCCGGCAGCACCTACTACAGCGACTCTGTGAAGGGCAGATTCACCATCAGCCGGGACAACGCCAAGAACAGC

CTGTACCTGCAGATGAACTCCCTGAGAGCCGAGGACACCGCCGTGTACTATTGTGCCAGAGGACCCATCTACAACGA

CTACGACGAGTTCGCCTATTGGGGCCAGGGCACACTGGTCACAGTTTCTAGCGGCGGTGGCGGAAgcGGAGGCGGTG

GCtccGGTGGCGGAGGCagcGAAATTGTGCTGACACAGAGCCCCGCCACACTGTCACTTTCTCCAGGCGAAAGAGCC

-continued

```
ACACTGAGCTGCAAGAGCAGCCAGAGCGTGCTGTACTCCAGCAACCAGAAGAACTACCTGGCCTGGTATCAGCAGAA

GCCCGGCCAAGCTCCTCGGCTGCTGATCTATTGGGCCAGCACAAGAGAGAGCGGCATCCCTGCCAGATTTTCTGGCA

GCGGCTCTGGCACCGATTTCACCCTGACCATAAGCAGCCTGGAACCTGAGGACTTCGCCGTGTATTACTGCCACCAG

TACCTGAGCAGCCTGACCTTTGGCGGAGGCACCAAGGTGGAAATCAAGCGG
```

```
                                                          (SEQ ID NO: 1681)
ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC
```

```
                                                          (SEQ ID NO: 1682)
ATCTACATCTGGGCGCCCTTGGCCGGGACTTGTGGGGTCCTTCTCCTGTCACTGGTTATCACCCTTTACTGC
```

```
                                                          (SEQ ID NO: 1683)
AAACGGGGCAGAAAGAAACTCCTGTATATATTCAAACAACCATTTATGAGACCAGTACAAACTACTCAAGAGGAAGA

TGGCTGTAGCTGCCGATTTCCAGAAGAAGAAGAAGGAGGATGTGAACTG
```

```
                                                          (SEQ ID NO: 1684)
AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTACAATGAACTGCAGAAAGATAAGATGGCGGAGGCCTACAGTGAGATTGGGATGAAA

GGCGAGCGCCGGAGGGGCAAGGGGCACGATGGCCTTTACCAGGGTCTCAGTACAGCCACCAAGGACACCTACGACGC

CCTTCACATGCAGGCCCTGCCCCCTCGCTGATAA

Construct Name: pCDH MSCV h20A10-C2 CAR 41BB
Construct backbone: pCDH CMV MCS (SBI)
Promoter MSCV
Leader sequence: Human CD8 alpha (1-63)
scFv Name: Humanized 20A10-C2 (64-807
Hinge region: Human CD8 alpha (808-942)
Transmembrane Domain: Human CD8 alpha (943-1014)
Costimulatory Domains: Human 41BB (1015-1140) and CD3 zeta (1141-1476)

(SEQ ID NO: 1685)
ATGGCCTTACCAGTGACCGCCTTGCTCCTGCCGCTGGCCTTGCTGCTCCACGCCGCCAGGCCGGAGGTGCAGCTGGT

TGAATCTGGCGGCGGACTTGTGAAGCCTGGCGGATCTCTGAGACTGAGCTGTGCCGCCAGCGGCTTCACCTTTAGCA

CATACGCCATGAGCTGGGTCCGACAGGCCCCTGGAAAAGGCCTTGAATGGGTTGCCTCTATCGGCAGAGCCGGCAGC

ACCTACTACAGCGATTCTGTGAAGGGCAGATTCACCATCAGCCGGGACAACGCCAAGAACAGCCTGTACCTGCAGAT

GAACTCCCTGAGAGCCGAGGACACCGCCGTGTACTATTGTGCCAGAGGACCCATCTACAACGACTACGACGAGTTCG

CCTATTGGGGCCAGGGCACACTGGTCACAGTCAGCTCTGGCGGTGGCGGAAgcGGAGGCGGTGGCtccGGTGGCGGA

GGCagcgacattgtgctgacccagtctccagcctccttggccgtgtctccaggacagagggccaccatcacctgcAA

GAGCAGCCAGAGCGTGCTGTACTCCAGCAACCAGAAGAACTACCTGGCCtggtatcagcagaaaccaggacaacctc ctaaactcctgatttacTGGGCCAGCACCAGAGAAAGCggggtcccagccaggttcagcggcagtgggtctgggacc gatttcaccctcacaattaatcctgtggaagctaatgatactgcaaattattactgtCACCAGTACCTGAGCAGCCT

GACCTTCGGCGGAGGGACCAAGGTGGAGATCAAACGAACAACAACCCCTGCCCCCAGACCTCCTACCCCAGCCCCTA

CAATTGCCAGCCAGCCTCTGAGCCTGAGGCCCGAGGCTTGTAGACCTGCTGCTGGCGGAGCCGTGCACACCAGAGGA

CTGGATTTCGCCTGCGACATCTACATCTGGGCGCCCTTGGCCGGGACTTGTGGGGTCCTTCTCCTGTCACTGGTTAT

CACCCTTTACTGCAAACGGGGCAGAAAGAAACTCCTGTATATATTCAAACAACCATTTATGAGACCAGTACAAACTA

CTCAAGAGGAAGATGGCTGTAGCTGCCGATTTCCAGAAGAAGAAGAAGGAGGATGTGAACTGAGAGTGAAGTTCAGC

AGGAGCGCAGACGCCCCCGCGTACAAGCAGGGCCAGAACCAGCTCTATAACGAGCTCAATCTAGGACGAAGAGAGGA
```

-continued

GTACGATGTTTTGGACAAGAGACGTGGCCGGGACCCTGAGATGGGGGGAAAGCCGAGAAGGAAGAACCCTCAGGAAG

GCCTGTACAATGAACTGCAGAAAGATAAGATGGCGGAGGCCTACAGTGAGATTGGGATGAAAGGCGAGCGCCGGAGG

GGCAAGGGGCACGATGGCCTTTACCAGGGTCTCAGTACAGCCACCAAGGACACCTACGACGCCCTTCACATGCAGGC

CCTGCCCCCTCGCTGATAA

CD8 leader sequence (SEQ ID NO 1686)

ATGGCCTTACCAGTGACCGCCTTGCTCCTGCCGCTGGCCTTGCTGCTCCACGCCGCCAGGCCG (SEQ ID NO: 1687)

GAGGTGCAGCTGGTTGAATCTGGCGGCGGACTTGTGAAGCCTGGCGGATCTCTGAGACTGAGCTGTGCCGCCAGCGG

CTTCACCTTTAGCACATACGCCATGAGCTGGGTCCGACAGGCCCCTGGAAAAGGCCTTGAATGGGTTGCCTCTATCG

GCAGAGCCGGCAGCACCTACTACAGCGATTCTGTGAAGGGCAGATTCACCATCAGCCGGGACAACGCCAAGAACAGC

CTGTACCTGCAGATGAACTCCCTGAGAGCCGAGGACACCGCCGTGTACTATTGTGCCAGAGGACCCATCTACAACGA

CTACGACGAGTTCGCCTATTGGGGCCAGGGCACACTGGTCACAGTCAGCTCTGGCGGTGGCGGAagcGGAGGCGGTG

GCtccGGTGGCGGAGGCagcgacattgtgctgacccagtctccagcctccttggccgtgtctccaggacagagggcc accatcacctgcAAGAGCAGCCAGAGCGTGCTGTACTCCAGCAACCAGAAGAACTACCTGGCCtggtatcagcagaa accaggacaacctcctaaactcctgatttacTGGGCCAGCACCAGAGAAAGCggggtcccagccaggttcagcggca gtgggtctgggaccgatttcaccctcacaattaatcctgtggaagctaatgatactgcaaattattactgtCACCAG

TACCTGAGCAGCCTGACCTTCGGCGGAGGGACCAAGGTGGAGATCAAACGA (SEQ ID NO: 1688)

ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC (SEQ ID NO: 1689)

ATCTACATCTGGGCGCCCTTGGCCGGGACTTGTGGGGTCCTTCTCCTGTCACTGGTTATCACCCTTTACTGC (SEQ ID NO: 1690)

AAACGGGGCAGAAAGAAACTCCTGTATATATTCAAACAACCATTTATGAGACCAGTACAAACTACTCAAGAGGAAGA

TGGCTGTAGCTGCCGATTTCCAGAAGAAGAAGAAGGAGGATGTGAACTG (SEQ ID NO: 1691)

AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTACAATGAACTGCAGAAAGATAAGATGGCGGAGGCCTACAGTGAGATTGGGATGAAA

GGCGAGCGCCGGAGGGGCAAGGGGCACGATGGCCTTTACCAGGGTCTCAGTACAGCCACCAAGGACACCTACGACGC

CCTTCACATGCAGGCCCTGCCCCCTCGCTGATAA

Construct Name: pCDH MSCV h20A10-O CAR CD28 1XX
Construct backbone: pCDH CMV MCS (SBI)
Promoter MSCV
Leader sequence: Human CD8 alpha (1-63)
scFv Name: Humanized 20A10-O (64-807)
Hinge region: Human CD8 alpha (808-942)
Transmembrane Domain: Human CD8 alpha (943-1014)
Costimulatory Domains: Human CD28 (1015-1137) and CD3 zeta 1XX (1138-1473)

(SEQ ID NO: 1692)

ATGGCCTTACCAGTGACCGCCTTGCTCCTGCCGCTGGCCTTGCTGCTCCACGCCGCCAGGCCGGAGGTGCAGCTGGT

TGAATCTGGCGGCGGACTTGTGAAGCCTGGCGGATCTCTGAGACTGAGCTGTGCCGCCAGCGGCTTCACCTTTAGCA

CATACGCCATGAGCTGGGTCCGACAGGCCCCTGGAAAAGGCCTTGAATGGGTTGCCTCTATCGGCAGAGCCGGCAGC

-continued

ACCTACTACAGCGATTCTGTGAAGGGCAGATTCACCATCAGCCGGGACAACGCCAAGAACAGCCTGTACCTGCAGAT

GAACTCCCTGAGAGCCGAGGACACCGCCGTGTACTATTGTGCCAGAGGACCCATCTACAACGACTACGACGAGTTCG

CCTATTGGGGCCAGGGCACACTGGTCACAGTCAGCTCTGGCGGTGGCGGAAgcGGAGGCGGTGGCtccGGTGGCGGA

GGCagcGACATCGTGATGACACAGAGCCCTGATAGCCTGGCCGTGTCTCTGGGAGAGAGAGCCACCATCAACTGCAA

GAGCAGCCAGAGCGTGCTGTACTCCAGCAACCAGAAGAACTACCTGGCCTGGTATCAGCAGAAGCCCGGCCAGCCTC

CTAAGCTGCTGATCTACTGGGCCAGCACCAGAGAAAGCGGCGTGCCCGATAGATTTTCTGGCAGCGGCTCTGGCACC

GACTTCACCCTGACAATTAGCTCCCTGCAGGCCGAGGATGTGGCCGTGTACTACTGTCACCAGTACCTGAGCAGCCT

GACCTTTGGCGGCGGAACAAAGGTGGAAATCAAGcgaACAACAACCCCTGCCCCCAGACCTCCTACCCCAGCCCCTA

CAATTGCCAGCCAGCCTCTGAGCCTGAGGCCCGAGGCTTGTAGACCTGCTGCTGGCGGAGCCGTGCACACCAGAGGA

CTGGATTTCGCCTGCGACATCTACATCTGGGCGCCCTTGGCCGGGACTTGTGGGGTCCTTCTCCTGTCACTGGTTAT

CACCCTTTACTGCAGGAGTAAGAGGAGCAGGCTCCTGCACAGTGACTACATGAACATGACTCCTAGAAGACCTGGGC

CTACCAGAAAGCATTACCAGCCCTATGCCCCACCACGCGACTTCGCAGCCTATCGCTCCAGAGTGAAGTTCAGCAGG

AGCGCAGACGCCCCCGCGTACAAGCAGGGCCAGAACCAGCTCTATAACGAGCTCAATCTAGGACGAAGAGAGGAGTA

CGATGTTTTGGACAAGAGACGTGGCCGGGACCCTGAGATGGGGGGGAAAGCCGAGAAGGAAGAACCCTCAGGAAGGCC

TGTtCAATGAACTGCAGAAAGATAAGATGGCGGAGGCCTtCAGTGAGATTGGGATGAAAGGCGAGCGCCGGAGGGGC

AAGGGGCACGATGGCCTTTtCCAGGGTCTCAGTACAGCCACCAAGGACACCTtCGACGCCCTTCACATGCAGGCCCT

GCCCCCTCGCTGATAA

CD8 leader sequence

(SEQ ID NO: 1693)
ATGGCCTTACCAGTGACCGCCTTGCTCCTGCCGCTGGCCTTGCTGCTCCACGCCGCCAGGCCG

scFv

(SEQ ID NO: 1694)
GAGGTGCAGCTGGTTGAATCTGGCGGCGGACTTGTGAAGCCTGGCGGATCTCTGAGACTGAGCTGTGCCGCCAGCGG

CTTCACCTTTAGCACATACGCCATGAGCTGGGTCCGACAGGCCCCTGGAAAAGGCCTTGAATGGGTTGCCTCTATCG

GCAGAGCCGGCAGCACCTACTACAGCGATTCTGTGAAGGGCAGATTCACCATCAGCCGGGACAACGCCAAGAACAGC

CTGTACCTGCAGATGAACTCCCTGAGAGCCGAGGACACCGCCGTGTACTATTGTGCCAGAGGACCCATCTACAACGA

CTACGACGAGTTCGCCTATTGGGGCCAGGGCACACTGGTCACAGTCAGCTCTGGCGGTGGCGGAAgcGGAGGCGGTG

GCtccGGTGGCGGAGGCagcGACATCGTGATGACACAGAGCCCTGATAGCCTGGCCGTGTCTCTGGGAGAGAGAGCC

ACCATCAACTGCAAGAGCAGCCAGAGCGTGCTGTACTCCAGCAACCAGAAGAACTACCTGGCCTGGTATCAGCAGAA

GCCCGGCCAGCCTCCTAAGCTGCTGATCTACTGGGCCAGCACCAGAGAAAGCGGCGTGCCCGATAGATTTTCTGGCA

GCGGCTCTGGCACCGACTTCACCCTGACAATTAGCTCCCTGCAGGCCGAGGATGTGGCCGTGTACTACTGTCACCAG

TACCTGAGCAGCCTGACCTTTGGCGGCGGAACAAAGGTGGAAATCAAGcga

Hinge domain

(SEQ ID NO: 1695)
ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC

Transmembrane domain

(SEQ ID NO: 1696)
ATCTACATCTGGGCGCCCTTGGCCGGGACTTGTGGGGTCCTTCTCCTGTCACTGGTTATCACCCTTTACTGC

4-1BB

(SEQ ID NO: 1697)
AGGAGTAAGAGGAGCAGGCTCCTGCACAGTGACTACATGAACATGACTCCTAGAAGACCTGGGCCTACCAGAAAGCA

TTACCAGCCCTATGCCCCACCACGCGACTTCGCAGCCTATCGCTCC

-continued (SEQ ID NO: 1698)
AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTtCAATGAACTGCAGAAAGATAAGATGGCGGAGGCCTtCAGTGAGATTGGGGATGAAA

GGCGAGCGCCGGAGGGGCAAGGGGCACGATGGCCTTTtCCAGGGTCTCAGTACAGCCACCAAGGACACCTtCGACGC

CCTTCACATGCAGGCCCTGCCCCCTCGCTGATAA

Constructu Name: pCDH MSCV h20A10-N CAR CD28 1XX
Constructu backbone: pCDH CMV MCS (SBI)
Promoter MSCV
Leader sequence: Human CD8 alpha (1-63)
scFv Name: Humanized 20A10-N (64-807)
Hinge region: Human CD8 alpha (808-942)
Transmembrane Doamin: Human CD8 alpha (943-1014)
Costimulatory Domains: Human CD28 (1015-1137) and CD3 zeta 1XX(1138-1473)

(SEQ ID NO: 1699)
ATGGCCTTACCAGTGACCGCCTTGCTCCTGCCGCTGGCCTTGCTGCTCCACGCCGCCAGGCCGCAGGTGCAGCTGGT

TGAATCTGGCGGCGGACTTGTGAAGCCTGGCGGATCTCTGAGACTGAGCTGTGCCGCCAGCGGCTTCACCTTTAGCA

CATACGCCATGAGCTGGATCAGACAGGCCCCTGGCAAAGGCCTGGAATGGGTGgcgTCTATTGGCAGAGCCGGCAGC

ACCTACTACAGCGACTCTGTGAAGGGCAGATTCACCATCAGCCGGGACAACGCCAAGAACAGCCTGTACCTGCAGAT

GAACTCCCTGAGAGCCGAGGACACCGCCGTGTACTATTGTGCCAGAGGACCCATCTACAACGACTACGACGAGTTCG

CCTATTGGGGCCAGGGCACACTGGTCACAGTTTCTAGCGGCGGTGGCGGAAgcGGAGGCGGTGGCtccGGTGGCGGA

GGCagcGAAATTGTGCTGACACAGAGCCCCGCCACACTGTCACTTTCTCCAGGCGAAAGAGCCACACTGAGCTGCAA

GAGCAGCCAGAGCGTGCTGTACTCCAGCAACCAGAAGAACTACCTGGCCTGGTATCAGCAGAAGCCCGGCCAAGCTC

CTCGGCTGCTGATCTATTGGGCCAGCACAAGAGAGAGCGGCATCCCTGCCAGATTTTCTGGCAGCGGCTCTGGCACC

GATTTCACCCTGACCATAAGCAGCCTGGAACCTGAGGACTTCGCCGTGTATTACTGCCACCAGTACCTGAGCAGCCT

GACCTTTGGCGGAGGCACCAAGGTGGAAATCAAGCGGACAACAACCCCTGCCCCCAGACCTCCTACCCCAGCCCCTA

CAATTGCCAGCCAGCCTCTGAGCCTGAGGCCCGAGGCTTGTAGACCTGCTGCTGGCGGAGCCGTGCACACCAGAGGA

CTGGATTTCGCCTGCGACATCTACATCTGGGCGCCCTTGGCCGGGACTTGTGGGGTCCTTCTCCTGTCACTGGTTAT

CACCCTTTACTGCAGGAGTAAGAGGAGCAGGCTCCTGCACAGTGACTACATGAACATGACTCCTAGAAGACCTGGGC

CTACCAGAAAGCATTACCAGCCCTATGCCCCACCACGCGACTTCGCAGCCTATCGCTCCAGAGTGAAGTTCAGCAGG

AGCGCAGACGCCCCCGCGTACAAGCAGGGCCAGAACCAGCTCTATAACGAGCTCAATCTAGGACGAAGAGAGGAGTA

CGATGTTTTGGACAAGAGACGTGGCCGGGACCCTGAGATGGGGGGAAAGCCGAGAAGGAAGAACCCTCAGGAAGGCC

TGTtCAATGAACTGCAGAAAGATAAGATGGCGGAGGCCTtCAGTGAGATTGGGGATGAAAGGCGAGCGCCGGAGGGGC

AAGGGGCACGATGGCCTTTtCCAGGGTCTCAGTACAGCCACCAAGGACACCTtCGACGCCCTTCACATGCAGGCCCT

GCCCCCTCGCTGATAA

CD8 leader sequence
(SEQ ID NO: 1700)
ATGGCCTTACCAGTGACCGCCTTGCTCCTGCCGCTGGCCTTGCTGCTCCACGCCGCCAGGCCG (SEQ ID NO: 1701)
CAGGTGCAGCTGGTTGAATCTGGCGGCGGACTTGTGAAGCCTGGCGGATCTCTGAGACTGAGCTGTGCCGCCAGCGG

CTTCACCTTTAGCACATACGCCATGAGCTGGATCAGACAGGCCCCTGGCAAAGGCCTGGAATGGGTGgcgTCTATTG

GCAGAGCCGGCAGCACCTACTACAGCGACTCTGTGAAGGGCAGATTCACCATCAGCCGGGACAACGCCAAGAACAGC

CTGTACCTGCAGATGAACTCCCTGAGAGCCGAGGACACCGCCGTGTACTATTGTGCCAGAGGACCCATCTACAACGA

CTACGACGAGTTCGCCTATTGGGGCCAGGGCACACTGGTCACAGTTTCTAGCGGCGGTGGCGGAAgcGGAGGCGGTG

GCtccGGTGGCGGAGGCagcGAAATTGTGCTGACACAGAGCCCCGCCACACTGTCACTTTCTCCAGGCGAAAGAGCC

-continued

ACACTGAGCTGCAAGAGCAGCCAGAGCGTGCTGTACTCCAGCAACCAGAAGAACTACCTGGCCTGGTATCAGCAGAA

GCCCGGCCAAGCTCCTCGGCTGCTGATCTATTGGGCCAGCACAAGAGAGAGCGGCATCCCTGCCAGATTTTCTGGCA

GCGGCTCTGGCACCGATTTCACCCTGACCATAAGCAGCCTGGAACCTGAGGACTTCGCCGTGTATTACTGCCACCAG

TACCTGAGCAGCCTGACCTTTGGCGGAGGCACCAAGGTGGAAATCAAGCGG (SEQ ID NO: 1702)
ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC (SEQ ID NO: 1703)
ATCTACATCTGGGCGCCCTTGGCCGGGACTTGTGGGGTCCTTCTCCTGTCACTGGTTATCACCCTTTACTGC (SEQ ID NO: 1704)
AGGAGTAAGAGGAGCAGGCTCCTGCACAGTGACTACATGAACATGACTCCTAGAAGACCTGGGCCTACCAGAAAGCA

TTACCAGCCCTATGCCCCACCACGCGACTTCGCAGCCTATCGCTCC (SEQ ID NO: 1705)
AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTtCAATGAACTGCAGAAAGATAAGATGGCGGAGGCCTtCAGTGAGATTGGGATGAAA

GGCGAGCGCCGGAGGGGCAAGGGGCACGATGGCCTTTtCCAGGGTCTCAGTACAGCCACCAAGGACACCTtCGACGC

CCTTCACATGCAGGCCCTGCCCCCTCGCTGATAA

Constructu Name: pCDH MSCV h20A10-C2 CAR CD28 1XX
Construct backbone: pCDH CMV MCS (SBI)
Promoter MSCV
Leader sequence: Human CD8 alpha (1-63)
scFv Name: Humanized 20A10-C2 (64-807)
Hinge region: Human CD8 alpha (808-942)
Transmembrane Domain: Human CD8 alpha (943-1014)
Costimulatory Domains: Human CD28 (1015-1137) and CD3 zeta 1XX (1138-1473)

(SEQ ID NO: 1706)
ATGGCCTTACCAGTGACCGCCTTGCTCCTGCCGCTGGCCTTGCTGCTCCACGCCGCCAGGCCGGAGGTGCAGCTGGT

TGAATCTGGCGGCGGACTTGTGAAGCCTGGCGGATCTCTGAGACTGAGCTGTGCCGCCAGCGGCTTCACCTTTAGCA

CATACGCCATGAGCTGGGTCCGACAGGCCCCTGGAAAAGGCCTTGAATGGGTTGCCTCTATCGGCAGAGCCGGCAGC

ACCTACTACAGCGATTCTGTGAAGGGCAGATTCACCATCAGCCGGGACAACGCCAAGAACAGCCTGTACCTGCAGAT

GAACTCCCTGAGAGCCGAGGACACCGCCGTGTACTATTGTGCCAGAGGACCCATCTACAACGACTACGACGAGTTCG

CCTATTGGGGCCAGGGCACACTGGTCACAGTCAGCTCTGGCGGTGGCGGAAgcGGAGGCGGTGGCtccGGTGGCGGA

GGCagcgacattgtgctgacccagtctccagcctccttggccgtgtctccaggacagagggccaccatcacctgcAA

GAGCAGCCAGAGCGTGCTGTACTCCAGCAACCAGAAGAACTACCTGGCCtggtatcagcagaaaccaggacaacctc ctaaactcctgatttacTGGGCCAGCACCAGAGAAAGCggggtcccagccaggttcagcggcagtgggtctgggacc gatttcaccctcacaattaatcctgtggaagctaatgatactgcaaattattactgtCACCAGTACCTGAGCAGCCT

GACCTTCGGCGGAGGGACCAAGGTGGAGATCAAACGAACAACAACCCCTGCCCCCAGACCTCCTACCCCAGCCCCTA

CAATTGCCAGCCAGCCTCTGAGCCTGAGGCCCGAGGCTTGTAGACCTGCTGCTGGCGGAGCCGTGCACACCAGAGGA

CTGGATTTCGCCTGCGACATCTACATCTGGGCGCCCTTGGCCGGGACTTGTGGGGTCCTTCTCCTGTCACTGGTTAT

CACCCTTTACTGCAGGAGTAAGAGGAGCAGGCTCCTGCACAGTGACTACATGAACATGACTCCTAGAAGACCTGGGC

CTACCAGAAAGCATTACCAGCCCTATGCCCCACCACGCGACTTCGCAGCCTATCGCTCCAGAGTGAAGTTCAGCAGG

AGCGCAGACGCCCCCGCGTACAAGCAGGGCCAGAACCAGCTCTATAACGAGCTCAATCTAGGACGAAGAGAGGAGTA

-continued

CGATGTTTTGGACAAGAGACGTGGCCGGGACCCTGAGATGGGGGGAAAGCCGAGAAGGAAGAACCCTCAGGAAGGCC

TGTtCAATGAACTGCAGAAAGATAAGATGGCGGAGGCCTtCAGTGAGATTGGGGATGAAAGGCGAGCGCCGGAGGGGC

AAGGGGCACGATGGCCTTTtCCAGGGTCTCAGTACAGCCACCAAGGACACCTtCGACGCCCTTCACATGCAGGCCCT

GCCCCCTCGCTGATAA

CD8 leader sequence (SEQ ID NO: 1707)

ATGGCCTTACCAGTGACCGCCTTGCTCCTGCCGCTGGCCTTGCTGCTCCACGCCGCCAGGCCG scFv C2

(SEQ ID NO: 1708)

GAGGTGCAGCTGGTTGAATCTGGCGGCGGACTTGTGAAGCCTGGCGGATCTCTGAGACTGAGCTGTGCCGCCAGCGG

CTTCACCTTTAGCACATACGCCATGAGCTGGGTCCGACAGGCCCCTGGAAAAGGCCTTGAATGGGTTGCCTCTATCG

GCAGAGCCGGCAGCACCTACTACAGCGATTCTGTGAAGGGCAGATTCACCATCAGCCGGGACAACGCCAAGAACAGC

CTGTACCTGCAGATGAACTCCCTGAGAGCCGAGGACACCGCCGTGTACTATTGTGCCAGAGGACCCATCTACAACGA

CTACGACGAGTTCGCCTATTGGGGCCAGGGCACACTGGTCACAGTCAGCTCTGGCGGTGGCGGAAgcGGAGGCGGTG

GCtccGGTGGCGGAGGCagcgacattgtgctgacccagtctccagcctccttggccgtgtctccaggacagagggcc accatcacctgcAAGAGCAGCCAGAGCGTGCTGTACTCCAGCAACCAGAAGAACTACCTGGCCtggtatcagcagaa accaggacaacctcctaaactcctgatttacTGGGCCAGCACCAGAGAAAGCggggtcccagccaggttcagcggca gtgggtctgggaccgatttcaccctcacaattaatcctgtggaagctaatgatactgcaaattattactgtCACCAG

TACCTGAGCAGCCTGACCTTCGGCGGAGGGACCAAGGTGGAGATCAAACGA

Hinge region (SEQ ID NO: 1709)

ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC

Transmembrane domain (SEQ ID NO: 1710)

ATCTACATCTGGGCGCCCTTGGCCGGGACTTGTGGGGTCCTTCTCCTGTCACTGGTTATCACCCTTTACTGC

41BB (SEQ ID NO: 1711)

AGGAGTAAGAGGAGCAGGCTCCTGCACAGTGACTACATGAACATGACTCCTAGAAGACCTGGGCCTACCAGAAAGCA

TTACCAGCCCTATGCCCCACCACGCGACTTCGCAGCCTATCGCTCC

CD3 zeta (SEQ ID NO: 1712)

AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTtCAATGAACTGCAGAAAGATAAGATGGCGGAGGCCTtCAGTGAGATTGGGATGAAA

GGCGAGCGCCGGAGGGGCAAGGGGCACGATGGCCTTTtCCAGGGTCTCAGTACAGCCACCAAGGACACCTtCGACGC

CCTTCACATGCAGGCCCTGCCCCCTCGCTGATAA

Constructu Name: pCDH MSCV hC2 CAR 41BB 6xNFATFoxP3 IL18
Constructu backbone: pCDH CMV MCS (SBI)
Promoter MSCV
Leader sequence: Human CD8 alpha (1-63)
scFv Name: Humanized C2 (64-8010)
Hinge region: Human CD8 alpha (811-945)
Transmembrane Domain: Human CD8 alpha (946-1017)
Costimulatory Domains: Human 41BB (1018-1143) and CD3 zeta (1144-1479)
NFAT response element: Human FoxP3 NFAT (6x) response element (1530-1691)
Minimal promoter: mCMV (1698-1815)
Leader sequence: Human CD8 alpha (1841-1903)
Cytokine: Human IL18 (1904-2374)

(SEQ ID NO: 1713)

ATGGCCTTACCAGTGACCGCCTTGCTCCTGCCGCTGGCCTTGCTGCTCCACGCCGCCAGGCCGGAGGTGCAGCTGGT

GGAGTCTGGGGGAGGCCTGGTCAAGCCTGGGGGGTCCCTGAGACTCTCCTGTGCAGCCTCTGGATTCACCTTCAGTG

-continued

GCTATGCCATGAGCTGGGTCCGCCAGGCTCCAGGGAAGGGGCTGGAGTGGGTCTCAACCATTAGTAGTGGCGGAACC

TACATATACTACCCCGACTCAGTGAAGGGCCGATTCACCATCTCCAGAGACAACGCCAAGAACTCACTGTATCTGCA

AATGAACAGCCTGAGAGCCGAGGACACGGCCGTGTATTACTGTGCGAGACTTGGGGGGGATAATTACTACGAATACT

TCGATGTCTGGGGCAAAGGGACCACGGTCACCGTCTCCTCCGGCGGTGGCGGATCCGGCGGTGGCGGATCCGGCGGT

GGCGGATCCGACATTGTGCTGACCCAGTCTCCAGCCTCCTTGGCCGTGTCTCCAGGACAGAGGGCCACCATCACCTG

CAGAGCCAGTAAGAGTGTCAGTACCAGCGGATACTCCTACATGCACTGGTATCAGCAGAAACCAGGACAACCTCCTA

AACTCCTGATTTACCTGGCATCCAATCTGGAGAGCGGGGTCCCAGCCAGGTTCAGCGGCAGTGGGTCTGGGACCGAT

TTCACCCTCACAATTAATCCTGTGGAAGCTAATGATACTGCAAATTATTACTGTCAGCACAGTAGGGAGCTGCCTTT

CACATTCGGCGGAGGGACCAAGGTGGAGATCAAACGAACTACAACAACCCCTGCCCCCAGACCTCCTACCCCAGCCC

CTACAATTGCCAGCCAGCCTCTGAGCCTGAGGCCCGAGGCTTGTAGACCTGCTGCTGGCGGAGCCGTGCACACCAGA

GGACTGGATTTCGCCTGCGACATCTACATCTGGGCGCCCTTGGCCGGGACTTGTGGGGTCCTTCTCCTGTCACTGGT

TATCACCCTTTACTGCAAACGGGGCAGAAAGAAACTCCTGTATATATTCAAACAACCATTTATGAGACCAGTACAAA

CTACTCAAGAGGAAGATGGCTGTAGCTGCCGATTTCCAGAAGAAGAAGAAGGAGGATGTGAACTGAGAGTGAAGTTC

AGCAGGAGCGCAGACGCCCCCGCGTACAAGCAGGGCCAGAACCAGCTCTATAACGAGCTCAATCTAGGACGAAGAGA

GGAGTACGATGTTTTGGACAAGAGACGTGGCCGGGACCCTGAGATGGGGGGAAAGCCGAGAAGGAAGAACCCTCAGG

AAGGCCTGTACAATGAACTGCAGAAAGATAAGATGGCGGAGGCCTACAGTGAGATTGGGATGAAAGGCGAGCGCCGG

AGGGGCAAGGGGCACGATGGCCTTTACCAGGGTCTCAGTACAGCCACCAAGGACACCTACGACGCCCTTCACATGCA

GGCCCTGCCCCCTCGCTGATAAGTTTAAACTGCCAGAACATTTCTCTGGCCTAACTGGCCGGTACCGGCTTCATTTT

TTCCATTTACTGCAGAGGCTTCATTTTTTCCATTTACTGCAGAGGCTTCATTTTTTCCATTTACTGCAGAGGCTTCA

TTTTTTCCATTTACTGCAGAGGCTTCATTTTTTCCATTTACTGCAGAGGCTTCATTTTTTCCATTTACTGCAGAact agttaggcgtgtacggtgggaggcctatataagcagagctcgtttagtgaaccgtcagatcgcctggagacgccatc cacgctgttttgacctccatagaagacaccgggaccgatccagcCTCGAGAGACCCAATGCTAGCCACCATGGCCTT

ACCAGTGACCGCCTTGCTCCTGCCGCTGGCCTTGCTGCTCCACGCCGCCAGGCCGTACTTCGGCAAGCTGGAAAGCA

AGCTGAGCGTGATCCGGAACCTGAACGACCAGGTGCTGTTCATCGATCAGGGCAACAGACCCCTGTTCGAGGACATG

ACCGACAGCGACTGCAGAGACAACGCCCCCTCGGACCATCTTCATCATCAGCATGTACAAGGACAGCCAGCCTAGAGG

CATGGCCGTGACCATCTCTGTGAAGTGCGAGAAGATCAGCACCCTGAGCTGCGAGAACAAGATCATCAGCTTCAAAG

AGATGAACCCGCCGGACAACATCAAGGACACCAAGAGCGACATCATATTCTTCCAGCGGAGCGTGCCCGGCCACGAC

AACAAGATGCAGTTTGAGAGCAGCAGCTACGAGGGCTACTTCCTGGCCTGCGAGAAAGAGCGGGACCTGTTCAAGCT

GATCCTGAAGAAAGAGGACGAACTGGGCGACCGCAGCATCATGTTCACCGTGCAGAACGAGGACTGAtaa

CDR leader sequence (SEQ ID NO: 1714)
ATGGCCTTACCAGTGACCGCCTTGCTCCTGCCGCTGGCCTTGCTGCTCCACGCCGCCAGGCCG (SEQ ID NO: 1715)
GAGGTGCAGCTGGTGGAGTCTGGGGGAGGCCTGGTCAAGCCTGGGGGGTCCCTGAGACTCTCCTGTGCAGCCTCTGG

ATTCACCTTCAGTGGCTATGCCATGAGCTGGGTCCGCCAGGCTCCAGGGAAGGGGCTGGAGTGGGTCTCAACCATTA

GTAGTGGCGGAACCTACATATACTACCCCGACTCAGTGAAGGGCCGATTCACCATCTCCAGAGACAACGCCAAGAAC

TCACTGTATCTGCAAATGAACAGCCTGAGAGCCGAGGACACGGCCGTGTATTACTGTGCGAGACTTGGGGGGGATAA

TTACTACGAATACTTCGATGTCTGGGGCAAAGGGACCACGGTCACCGTCTCCTCCGGCGGTGGCGGATCCGGCGGTG

GCGGATCCGGCGGTGGCGGATCCGACATTGTGCTGACCCAGTCTCCAGCCTCCTTGGCCGTGTCTCCAGGACAGAGG

GCCACCATCACCTGCAGAGCCAGTAAGAGTGTCAGTACCAGCGGATACTCCTACATGCACTGGTATCAGCAGAAACC

AGGACAACCTCCTAAACTCCTGATTTACCTGGCATCCAATCTGGAGAGCGGGGTCCCAGCCAGGTTCAGCGGCAGTG

-continued

GGTCTGGGACCGATTTCACCCTCACAATTAATCCTGTGGAAGCTAATGATACTGCAAATTATTACTGTCAGCACAGT

AGGGAGCTGCCTTTCACATTCGGCGGAGGGACCAAGGTGGAGATCAAACGAACT

▓▓▓▓▓▓▓▓▓▓▓▓▓▓
                                                                                    (SEQ ID NO: 1716)
ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC

▓▓▓▓▓▓▓▓▓▓▓▓▓▓▓▓▓
                                                                                    (SEQ ID NO: 1717)
ATCTACATCTGGGCGCCCTTGGCCGGGACTTGTGGGGTCCTTCTCCTGTCACTGGTTATCACCCTTTACTGC

▓▓▓▓
                                                                                    (SEQ ID NO: 1718)
AAACGGGGCAGAAAGAAACTCCTGTATATATTCAAACAACCATTTATGAGACCAGTACAAACTACTCAAGAGGAAGA

TGGCTGTAGCTGCCGATTTCCAGAAGAAGAAGAAGGAGGATGTGAACTG

▓▓▓
                                                                                    (SEQ ID NO: 1719)
AGAGTGAAGTTCAGCAGGAGCGCAGACGCCCCCGCGTACAAGCAGGGCCAGAACCAGCTCTATAACGAGCTCAATCT

AGGACGAAGAGAGGAGTACGATGTTTTGGACAAGAGACGTGGCCGGGACCCTGAGATGGGGGGAAAGCCGAGAAGGA

AGAACCCTCAGGAAGGCCTGTACAATGAACTGCAGAAAGATAAGATGGCGGAGGCCTACAGTGAGATTGGGATGAAA

GGCGAGCGCCGGAGGGGCAAGGGGCACGATGGCCTTTACCAGGGTCTCAGTACAGCCACCAAGGACACCTACGACGC

CCTTCACATGCAGGCCCTGCCCCCTCGC plasmid
                                                                                    (SEQ ID NO: 1720)
TGATAAGTTTAAACTGCCAGAACATTTCTCTGGCCTAACTGGCCGGTACC ▓▓▓▓▓▓▓▓▓▓▓
                                                                                    (SEQ ID NO: 1721)
GGCTTCATTTTTTCCATTTACTGCAGAGGCTTCATTTTTTCCATTTACTGCAGAGGCTTCATTTTTTCCATTTACTG CAGAGGCTTCATTTTTTCCATTTACTGCAGAGGCTTCATTTTTTCCATTTACTGCAGAGGCTTCATTTTTTCCATTT
ACTGCAGAactagt mCMV
                                                                                    (SEQ ID NO: 1722)
Taggcgtgtacggtgggaggcctatataagcagagctcgtttagtgaaccgtcagatcgcctggagacgccatccac gctgttttgacctccatagaagacaccgggaccgatccagc plasmid
                                                                                    (SEQ ID NO: 1723)
CTCGAGAGACCCAATGCTAGCCACC (SEQ ID NO: 1724)
ATGGCCTTACCAGTGACCGCCTTGCTCCTGCCGCTGGCCTTGCTGCTCCACGCCGCCAGGCCG ▓▓▓▓▓
                                                                                    (SEQ ID NO: 1725)
TACTTCGGCAAGCTGGAAAGCAAGCTGAGCGTGATCCGGAACCTGAACGACCAGGTGCTGTTCATCGATCAGGGCAA

CAGACCCCTGTTCGAGGACATGACCGACAGCGACTGCAGAGACAACGCCCCTCGGACCATCTTCATCATCAGCATGT

ACAAGGACAGCCAGCCTAGAGGCATGGCCGTGACCATCTCTGTGAAGTGCGAGAAGATCAGCACCCTGAGCTGCGAG

AACAAGATCATCAGCTTCAAAGAGATGAACCCGCCGGACAACATCAAGGACACCAAGAGCGACATCATATTCTTCCA

GCGGAGCGTGCCCGGCCACGACAACAAGTGCAGTTTGAGAGCAGCAGCTACGAGGGCTACTTCCTGGCCTGCGAGA

AAGAGCGGGACCTGTTCAAGCTGATCCTGAAGAAAGAGGACGAACTGGGCGACCGCAGCATCATGTTCACCGTGCAG

AACGAGGACTGAtaa

Construct Name: pCDH MSCV hC2 CAR CD28 1XX
Construct backbone: pCDH CMV MCS (SBI)
Promoter MSCV
Leader sequence: Human CD8 alpha (1-63)
scFv Name: Humanized C2 (64-8010)
Hinge region: Human CD8 alpha (811-945)

-continued

Transmembrane Domain: Human CD8 alpha (946-1017)
Costimulatory Domains: Human CD28 (1018-1140) and CD3 zeta 1XX (1141-1476)

(SEQ ID NO: 1726)
ATGGCCTTACCAGTGACCGCCTTGCTCCTGCCGCTGGCCTTGCTGCTCCACGCCGCCAGGCCGGAGGTGCAGCTGGT

GGAGTCTGGGGGAGGCCTGGTCAAGCCTGGGGGGTCCCTGAGACTCTCCTGTGCAGCCTCTGGATTCACCTTCAGTG

GCTATGCCATGAGCTGGGTCCGCCAGGCTCCAGGGAAGGGGCTGGAGTGGGTCTCAACCATTAGTAGTGGCGGAACC

TACATATACTACCCCGACTCAGTGAAGGGCCGATTCACCATCTCCAGAGACAACGCCAAGAACTCACTGTATCTGCA

AATGAACAGCCTGAGAGCCGAGGACACGGCCGTGTATTACTGTGCGAGACTTGGGGGGGATAATTACTACGAATACT

TCGATGTCTGGGGCAAAGGGACCACGGTCACCGTCTCCTCCGGCGGTGGCGGATCCGGCGGTGGCGGATCCGGCGGT

GGCGGATCCGACATTGTGCTGACCCAGTCTCCAGCCTCCTTGGCCGTGTCTCCAGGACAGAGGGCCACCATCACCTG

CAGAGCCAGTAAGAGTGTCAGTACCAGCGGATACTCCTACATGCACTGGTATCAGCAGAAACCAGGACAACCTCCTA

AACTCCTGATTTACCTGGCATCCAATCTGGAGAGCGGGGTCCCAGCCAGGTTCAGCGGCAGTGGGTCTGGGACCGAT

TTCACCCTCACAATTAATCCTGTGGAAGCTAATGATACTGCAAATTATTACTGTCAGCACAGTAGGGAGCTGCCTTT

CACATTCGGCGGAGGGACCAAGGTGGAGATCAAACGAACTACAACAACCCCTGCCCCCAGACCTCCTACCCCAGCCC

CTACAATTGCCAGCCAGCCTCTGAGCCTGAGGCCCGAGGCTTGTAGACCTGCTGCTGGCGGAGCCGTGCACACCAGA

GGACTGGATTTCGCCTGCGACATCTACATCTGGGCGCCCTTGGCCGGGACTTGTGGGGTCCTTCTCCTGTCACTGGT

TATCACCCTTTACTGCAGGAGTAAGAGGAGCAGGCTCCTGCACAGTGACTACATGAACATGACTCCTAGAAGACCTG

GGCCTACCAGAAAGCATTACCAGCCCTATGCCCCACCACGCGACTTCGCAGCCTATCGCTCCAGAGTGAAGTTCAGC

AGGAGCGCAGACGCCCCCGCGTACAAGCAGGGCCAGAACCAGCTCTATAACGAGCTCAATCTAGGACGAAGAGAGGA

GTACGATGTTTTGGACAAGAGACGTGGCCGGGACCCTGAGATGGGGGGAAAGCCGAGAAGGAAGAACCCTCAGGAAG

GCCTGTtCAATGAACTGCAGAAAGATAAGATGGCGGAGGCCTtCAGTGAGATTGGGATGAAAGGCGAGCGCCGGAGG

GGCAAGGGGCACGATGGCCTTTtCCAGGGTCTCAGTACAGCCACCAAGGACACCTtCGACGCCCTTCACATGCAGGC

CCTGCCCCCTCGCTGATAA

CD8 leader sequence
(SEQ ID NO: 1727)
ATGGCCTTACCAGTGACCGCCTTGCTCCTGCCGCTGGCCTTGCTGCTCCACGCCGCCAGGCCG (SEQ ID NO: 1728)
GAGGTGCAGCTGGTGGAGTCTGGGGGAGGCCTGGTCAAGCCTGGGGGGTCCCTGAGACTCTCCTGTGCAGCCTCTGG

ATTCACCTTCAGTGGCTATGCCATGAGCTGGGTCCGCCAGGCTCCAGGGAAGGGGCTGGAGTGGGTCTCAACCATTA

GTAGTGGCGGAACCTACATATACTACCCCGACTCAGTGAAGGGCCGATTCACCATCTCCAGAGACAACGCCAAGAAC

TCACTGTATCTGCAAATGAACAGCCTGAGAGCCGAGGACACGGCCGTGTATTACTGTGCGAGACTTGGGGGGGATAA

TTACTACGAATACTTCGATGTCTGGGGCAAAGGGACCACGGTCACCGTCTCCTCCGGCGGTGGCGGATCCGGCGGTG

GCGGATCCGGCGGTGGCGGATCCGACATTGTGCTGACCCAGTCTCCAGCCTCCTTGGCCGTGTCTCCAGGACAGAGG

GCCACCATCACCTGCAGAGCCAGTAAGAGTGTCAGTACCAGCGGATACTCCTACATGCACTGGTATCAGCAGAAACC

AGGACAACCTCCTAAACTCCTGATTTACCTGGCATCCAATCTGGAGAGCGGGGTCCCAGCCAGGTTCAGCGGCAGTG

GGTCTGGGACCGATTTCACCCTCACAATTAATCCTGTGGAAGCTAATGATACTGCAAATTATTACTGTCAGCACAGT

AGGGAGCTGCCTTTCACATTCGGCGGAGGGACCAAGGTGGAGATCAAACGAACT (SEQ ID NO: 1729)
ACAACAACCCCTGCCCCCAGACCTCCTACCCCAGCCCCTACAATTGCCAGCCAGCCTCTGAGCCTGAGGCCCGAGGC

TTGTAGACCTGCTGCTGGCGGAGCCGTGCACACCAGAGGACTGGATTTCGCCTGCGAC

-continued (SEQ ID NO: 1730)
ATCTACATCTGGGCGCCCTTGGCCGGGACTTGTGGGGTCCTTCTCCTGTCACTGGTTATCACCCTTTACTGC (SEQ ID NO: 1731)
AGGAGTAAGAGGAGCAGGCTCCTGCACAGTGACTACATGAACATGACTCCTAGAAGACCTGGGCCTACCAGAAAGCA

TTACCAGCCCTATGCCCCACCACGCGACTTCGCAGCCTATCGCTCC (SEQ ID NO: 1732)
AGAGTGAAGTTCAGCAGGAGCGCAGACGCCCCCGCGTACAAGCAGGGCCAGAACCAGCTCTATAACGAGCTCAATCTA

GGACGAAGAGAGGAGTACGATGTTTTGGACAAGAGACGTGGCCGGGACCCTGAGATGGGGGGAAAGCCGAGAAGGAAG

AACCCTCAGGAAGGCCTGTtCAATGAACTGCAGAAAGATAAGATGGCGGAGGCCTtCAGTGAGATTGGGATGAAAGGC

CAGCGCCGGAGGGGCAAGGGGCACGATGGCCTTTtCCAGGGTCTCAGTACAGCCACCAAGGACACCTtCGACGCCCTT

CACATGCAGGCCCTGCCCCCTCGCTGATAA

Mouse B12 light chain variable framework 2 (FR2) sequence:
(DNA)
(SEQ ID NO: 1733)
tggtatcagcagaaaccaggacagccacccaaactcctcatctat (amino acids)
(SEQ ID NO: 1734)
WYQQKPGQPPKLLIY Mouse B12 light chain variable complementarity determining regions 2 (CDR2)
Sequence:
(DNA)
(SEQ ID NO: 1735)
cttgcatccaccctagattct (amino acids)
(SEQ ID NO: 1736)
LASTLDS Mouse B12 light chain variable framework 3 (FR3) sequence:
(DNA)
(SEQ ID NO: 1737)
ggggtccctgccaggttcagtggcagtgggtctaggacagacttcaccctcaccattgatcctgtggaggctgatga tgctgcaacctattactgt (amino acids)
(SEQ ID NO: 1738)
GVPARFSGSGSRTDFTLTIDPVEADDAATYYC Mouse B12 light chain variable complementarity determining regions 3 (CDR3)
Sequence:
(DNA)
(SEQ ID NO: 1739)
cagcaaaataatgaggatcctccgacg (amino acids)
(SEQ ID NO: 1740)
QQNNEDPPT Mouse B12 light chain variable framework 4 (FR4) sequence:
(DNA)
(SEQ ID NO: 1741)
ttcggtggaggcaccaagctggaaatcaagg (amino acids)
(SEQ ID NO: 1742)
FGGGTKLEIK epitope to which NME1 and NME7AB bind part of the 10 membrane proximal amino
acids
(SEQ ID NO: 1743)
PFPFSAQSGA

(SEQ ID NO: 1744)
SNIKFRPGSVV

-continued (SEQ ID NO: 1745)
ASRYNLT

Fragment of PSMGFR
(SEQ ID NO: 1746)
GTINVHDVET

Fragment of PSMGFR
(SEQ ID NO: 1747)
FPFS

Fragment of PSMGFR
(SEQ ID NO: 1748)
SNIKFRPGSVVVQLTLAFRE

Fragment of PSMGFR
(SEQ ID NO: 1749)
QFNQYKTEA

Fragment of PSMGFR
(SEQ ID NO: 1750)
VQLTLAFRE

Fragment of PSMGFR
(SEQ ID NO: 1751)
SVSDV

IL18 sequence
(DNA)
(SEQ ID NO: 1752)
Atagaagacaccgggaccgatccagcctcgagagacccaatgctagccaccatggccttaccagtgac cgccttgctcctgccgctggccttgctgctccacgccgccaggccgtacttcggcaagctggaaagcaagctgagcg tgatccggaacctgaacgaccaggtgctgttcatcgatcagggcaacagacccctgttcgaggacatgaccgacagc gactgcagagacaacgcccctcggaccatcttcatcatcagcatgtacaaggacagccagcctagaggcatggccgt gaccatctctgtgaagtgcgagaagatcagcaccctgagctgcgagaacaagatcatcagcttcaaagagatgaacc cgccggacaacatcaaggacaccaagagcgacatcatattcttccagcggagcgtgcccggccacgacaacaagatg cagtttgagagcagcagctacgagggctacttcctggcctgcgagaaagagcgggacctgttcaagctgatcctgaa gaaagaggacgaactgggcgaccgcagcatcatgttcaccgtgcagaacgaggactgataaaagcttggcaatccgg tactgttggtaaagccacca (amino acids)
(SEQ ID NO: 1753)
IEDTGTDPASRDPMLATMALPVTALLLPLALLLHAARPYFGKLESKLSVIRMLNDQVLFIDQGNRPLFEDMTDSDCR

DNAPRTIFIISMYKDSQPRGMAVTISVKCEKISTLSCENKIISFKEMNPPDNIKDTKSDIIFFQRSVPGHDNKMQFE

SSSYEGYFLACEKERDLFKLILKKEDELGDRSIMFTVQNED**KLGNPVLLVKPP
primer (SEQ ID NO: 1754)
5'-agggagacccaagctggctagttaagcttggatggccttaccagtgaccgccttgc-3'
primer (SEQ ID NO: 1755)
5'-taggccagagaaatgttctggcattatcagcgaggggcagggcctgc-3'

(SEQ ID NO: 1756)
5'-tgccagaacatttctctgg-3'

(SEQ ID NO: 1757)
5'-acagtcgaggctgatcagcgggtttaaacttatcagtcctcgttctgcacgg-3'

(SEQ ID NO: 1758)
5'-atgcaggccctgccccctcgctgataagtttaaactgccagaacatttctctggcctaac-3'

(SEQ ID NO: 1759)
5'-accggagcgatcgcagatccttcgcggccgcttatcagtcctcgttctgcacggtgaac-3'

(SEQ ID NO: 1760)
5'-attgcactagttgaaagaccccacctgtagg-3'

(SEQ ID NO: 1761)
5'-aatgctctagaatacgggtatccagg-3'

-continued (SEQ ID NO: 1762)
5' atagcgaattcgtaccgagggccaccatgg-3'

(SEQ ID NO: 1763)
5'-taggcctcccaccgtacacgcctaggtaccacgccttctgtatg-3'

(SEQ ID NO: 1764)
5'-taggcctcccaccgtacacgcctaggtacctctgcagtaaatgg-3'

(SEQ ID NO: 1765)
5'-taaggccatggtggctagc-3'

(SEQ ID NO: 1766)
5'-aataagtttaaactgccagaacatttctctgg-3'

(SEQ ID NO: 1767)
5'-atatagcggccgcttatcagtcctcgttctgcacgg-3'

6x FoxP3NFAT mCMV
(DNA)
(SEQ ID NO: 1768)
Agaacatttctctggcctaactggccggtaccggcttcattttttccatttactgcagaggcttcatt ttttccatttactgcagaggcttcattttttccatttactgcagaggcttcattttttccatttactgcagaggctt cattttttccatttactgcagaggcttcattttttccatttactgcagaactagttaggcgtgtacggtgggaggcc tatataagcagagctcgtttagtgaaccgtcagatcgcctggagacgccatccacgctgttttgacctccatagaag acaccgggaccgatccagcctcgagagacccaatgctagccaccatgg (amino acids)
(SEQ ID NO: 1769)
RTFLWPNWPVPASFFPFTAEASFFPFTAEASFFPFTAEASFFPFTAEASFFPFTAELVR

RVRWEAYISRARLVNRQIAWRRHPRCFDLHRRHRDRSSLERPNASHHG

6x FoxP3NFAT mIL2P
(DNA)
(SEQ ID NO: 1770)
Agaacatttctctggcctaactggccggtaccggcttcattttttccatttactgcagaggcttcatt ttttccatttactgcagaggcttcattttttccatttactgcagaggcttcattttttccatttactgcagaggctt cattttttccatttactgcagaggcttcattttttccatttactgcagaactagtcattttgacacccccataatat ttttccagaattaacagtataaattgcatctcttgttcaagagtttccctatcactctctttaatcactactcacagt aacctcaactcctgcctcgagagacccaatgctagccaccatgg (amino acids)
(SEQ ID NO: 1771)
RTFLWPNWPVPASFFPFTAEASFFPFTAEASFFPFTAEASFFPFTAEASFFPFTAELVI

LTPP*YFSRINSINCISCSRVPYHSL*SLLTVTSTPASRDPMLATMX

6x FoxP3NFAT miniP
(DNA)
(SEQ ID NO: 1772)
Agaacatttctctggcctaactggccggtaccggcttcattttttccatttactgcagaggcttcatt ttttccatttactgcagaggcttcattttttccatttactgcagaggcttcattttttccatttactgcagaggctt cattttttccatttactgcagaggcttcattttttccatttactgcagaactagtagagggtatataatggaagctc gacttccagctcgagagacccaatgctagccaccatgg (amino acids)
(SEQ ID NO: 1773)
RTFLWPNWPVPASFFPFTAEASFFPFTAEASFFPFTAEASFFPFTAEASFFPFTAELVE
GI*WKLDFQLERPNASHHG 6x IL2NFAT mCMV
(DNA)
(SEQ ID NO: 1774)
Agaacatttctctggcctaactggccggtaccggaggaaaaactgtttcatacagaaggcgtggagga aaaactgtttcatacagaaggcgtggaggaaaaactgtttcatacagaaggcgtggaggaaaaactgtttcatacag aaggcgtggaggaaaaactgtttcatacagaaggcgtggaggaaaaactgtttcatacagaaggcgtactagttagg cgtgtacggtgggaggcctatataagcagagctcgtttagtgaaccgtcagatcgcctggagacgccatccacgctg ttttgacctccatagaagacaccgggaccgatccagcctcgagagacccaatgctagccaccatgg (amino acids)

(SEQ ID NO: 1775)

RTFLWPNWPVPEEKLFHTEGVEEKLFHTEGVEEKLFHTEGVEEKLFHTEGVEEKLFHTEGVEEKLFHT

EGVLVRRVRWEAYISRARLVNRQIAWRRHPRCFDLHRRHRDRSSLERPNASHHG

6x IL2NFAT mIL2P
(DNA)

(SEQ ID NO: 1776)

Agaacatttctctggcctaactggccggtaccggaggaaaaactgtttcatacagaaggcgtggagga aaaactgtttcatacagaaggcgtggaggaaaaactgtttcatacagaaggcgtggaggaaaaactgtttcatacag aaggcgtggaggaaaaactgtttcatacagaaggcgtggaggaaaaactgtttcatacagaaggcgtactagtcatt ttgacacccccataatattttccagaattaacagtataaattgcatctcttgttcaagagttccctatcactctct ttaatcactactcacagtaacctcaactcctgcctcgagagacccaatgctagccaccatgg (amino acids)

(SEQ ID NO: 1777)

RTFLWPNWPVPEEKLFHTEGVEEKLFHTEGVEEKLFHTEGVEEKLFHTEGVEEKLFHTEGVEEKLFHT

EGVLVILTPP*YFSRINSINCISCSRVPYHSL*SLLTVTSTPASRDPMLATMX

6x IL2NFAT miniP
(DNA)

(SEQ ID NO: 1778)

Agaacatttctctggcctaactggccggtaccggaggaaaaactgtttcatacagaaggcgtggagga aaaactgtttcatacagaaggcgtggaggaaaaactgtttcatacagaaggcgtggaggaaaaactgtttcatacag aaggcgtggaggaaaaactgtttcatacagaaggcgtggaggaaaaactgtttcatacagaaggcgtactagtagag ggtatataatggaagctcgacttccagctcgagagacccaatgctagccaccatgg (amino acids)

(SEQ ID NO: 1779)

RTFLWPNWPVPEEKLFHTEGVEEKLFHTEGVEEKLFHTEGVEEKLFHTEGVEEKLFHTEGVEEKLFHT

EGVLVEGI*WKLDFQLERPNASHHG

Human NME1
(DNA)

(SEQ ID NO: 1780)

atggccaactgtgagcgtaccttcattgcgatcaaaccagatggggtccagcggggtcttgtgggagagattatcaa gcgttttgagcagaaaggattccgccttgttggtctgaaattcatgcaagcttccgaagatcttctcaaggaacact acgttgacctgaaggaccgtccattctttgccggcctggtgaaatacatgcactcagggccggtagttgccatggtc tgggaggggctgaatgtggtgaagacgggccgagtcatgctcggggagaccaaccctgcagactccaagcctgggac catccgtggagacttctgcatacaagttggcaggaacattatacatggcagtgattctgtggagagtgcagagaagg agatcggcttgtggtttcaccctgaggaactggtagattacacgagctgtgctcagaactggatctatgaatga (amino acids)

(SEQ ID NO: 1781)

MANCERTFIAIKPDGVQRGLVGEIIKRFEQKGFRLVGLKFMQASEDLLKEHYVDLKDRPFFAGLVKYMHSGPVVAMV

WEGLNVVKTGRVMLGETNPADSKPGTIRGDFCIQVGRNIIHGSDSVESAEKEIGLWFHPEELVDYTSCAQNWIYE-

Human NME7
(DNA)

(SEQ ID NO: 1782)

atgaatcatagtgaaagattcgtttttcattgcagagtggtatgatccaaatgcttcacttcttcgacgttatgagct tttattttacccaggggatggatctgttgaaatgcatgatgtaaagaatcatcgcacctttttaaagcggaccaaat atgataacctgcacttggaagatttatttataggcaacaaagtgaatgtcttttctcgacaactggtattaattgac tatggggatcaatatacagctcgccagctgggcagtaggaaagaaaaaacgctagccctaattaaaccagatgcaat atcaaaggctggagaaataattgaaataataaacaaagctggatttactataaccaaactcaaaatgatgatgcttt -continued
caaggaaagaagcattggattttcatgtagatcaccagtcaagaccctttttcaatgagctgatccagtttattaca actggtcctattattgccatggagattttaagagatgatgctatatgtgaatggaaaagactgctgggacctgcaaa ctctggagtggcacgcacagatgcttctgaaagcattagagccctctttggaacagatggcataagaaatgcagcgc atggccctgattcttttgcttctgcggccagagaaatggagttgttttttccttcaagtggaggttgtgggccggca aacactgctaaatttactaattgtacctgttgcattgttaaaccccatgctgtcagtgaaggactgttgggaaagat cctgatggctatccgagatgcaggttttgaaatctcagctatgcagatgttcaatatggatcgggttaatgttgagg aattctatgaagtttataaaggagtagtgaccgaatatcatgacatggtgacagaaatgtattctggcccttgtgta gcaatggagattcaacagaataatgctacaaagacatttcgagaatttttgtggacctgctgatcctgaaattgcccg gcatttacgccctggaactctcagagcaatctttggtaaaactaagatccagaatgctgttcactgtactgatctgc cagaggatggcctattagaggttcaatacttcttcaagatcttggataattag (amino acids)
(SEQ ID NO: 1783)
MNHSERFVFIAEWYDPNASLLRRYELLFYPGDGSVEMHDVKNHRTFLKRTKYDNLHLEDLFIGNKVNVFSRQLVLID

YGDQYTARQLGSRKEKTLALIKPDAISKAGEITEIINKAGFTITKLKMMMLSRKEALDFHVDHQSRPFFNELIQFIT

TGPIIAMEILRDDAICEWKRLLGPANSGVARTDASESIRALFGTDGIRNAAHGPDSFASAAREMELFFPSSGGCGPA

NTAKFTNCTCCIVKPHAVSEGLLGKILMAIRDAGFEISAMQMFNMDRVNVEEFYEVYKGVVTEYHDMVTEMYSGPCV

AMEIQQNNATKTFREFCGPADPEIARHLRPGTLRAIFGKTKIQNAVHCTDLPEDGLLEVQYFFKILDN-

Those skilled in the art will recognize, or be able to ascertain using no more than routine experimentation, many equivalents to the specific embodiments of the invention specifically described herein.

SEQUENCE LISTING (1813 sequences)

SEQ ID NO: 1 - protein, 1255 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAAASANL

SEQ ID NO: 2 - protein, 45 aa, Artificial Sequence
  PSMGFR sequence
GTINVHDVETQFNQYKTEAASRYNLTISDVSVSDVPFPFSAQSGA

SEQ ID NO: 3 - protein, 35 aa, Artificial Sequence
  N-10 peptide
QFNQYKTEAASRYNLTISDVSVSDVPFPFSAQSGA

SEQ ID NO: 4 - protein, 26 aa, Artificial Sequence
  N-19 peptide
ASRYNLTISDVSVSDVPFPFSAQSGA

SEQ ID NO: 5 - protein, 22 aa, Artificial Sequence
  N-23 peptide
NLTISDVSVSDVPFPFSAQSGA

SEQ ID NO: 6 - protein, 19 aa, Artificial Sequence
  N-26 peptide
ISDVSVSDVPFPFSAQSGA

SEQ ID NO: 7 - protein, 15 aa, Artificial Sequence
  N-30 peptide
SVSDVPFPFSAQSGA

SEQ ID NO: 8 - protein, 30 aa, Artificial Sequence
  N-10/C-5 peptide
QFNQYKTEAASRYNLTISDVSVSDVPFPFS

SEQ ID NO: 9 - protein, 21 aa, Artificial Sequence
  N-19/C-5 peptide
ASRYNLTISDVSVSDVPFPFS

SEQ ID NO: 10 - protein, 9 aa, Artificial Sequence
  N-36 peptide
FPFSAQSGA

SEQ ID NO: 11 - skipped

SEQ ID NO: 12 - DNA, 366 bp, Artificial Sequence
  Mouse E6 Heavy chain variable region sequence
gaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctca

SEQ ID NO: 13 - protein, 122 aa, Artificial Sequence
  Mouse E6 Heavy chain variable region sequence
EVKVVESGGDLVKPGGSLKLSCVVSGFTFSRYGMSWVRQTPGKRLEWVATISGGGTYIYYPDSVKGRFTISRDNAKNTLYLQMSSLKSEDTAMYHCTRDNYGRNYDYGMDYWGQGTSVTVSS

SEQ ID NO: 14 - DNA, 75 bp, Artificial Sequence
  Mouse E6 heavy chain variable framework region 1 (FWR1) sequence
gaggtgaaggtggtggagtctgggggagacttagtgaagcctggagggtccctgaaactctcctgtgtagtctct

SEQ ID NO: 15 - protein, 30 aa, Artificial Sequence
  Mouse E6 heavy chain variable framework region 1 (FWR1) sequence
EVKVVESGGDLVKPGGSLKLSCVVSGFTFS

SEQ ID NO: 16 - DNA, 30 bp, Artificial Sequence
  Mouse E6 heavy chain variable complementarity determining regions 1 (CDR1) sequence
ggattcactttcagtagatatggcatgtct

SEQ ID NO: 17 - protein, 5 aa, Artificial Sequence
  Mouse E6 heavy chain variable complementarity determining regions 1 (CDR1) sequence
RYGMS

SEQ ID NO: 18 - DNA, 42 bp, Artificial Sequence
  Mouse E6 heavy chain variable framework region 2 (FWR2) sequence
tgggttcgccagactccaggcaagaggctggagtgggtcgca

SEQ ID NO: 19 - protein, 14 aa, Artificial Sequence
  Mouse E6 heavy chain variable framework region 2 (FWR2) sequence
WVRQTPGKRLEWVA

SEQ ID NO: 20 - DNA, 51 bp, Artificial Sequence
  Mouse E6 heavy chain variable complementarity determining regions 2 (CDR2) sequence
accattagtggtggcggtacttacatctactatccagacagtgtgaagggg

SEQ ID NO: 21 - protein, 17 aa, Artificial Sequence
  Mouse E6 heavy chain variable complementarity determining regions 2 (CDR2) sequence
TISGGGTYIYYPDSVKG

SEQ ID NO: 22 - DNA, 96 bp, Artificial Sequence
  Mouse E6 heavy chain variable framework region 3 (FWR3) acid sequence
cgattcaccatctccagagacaatgccaagaacaccctgtacctgcaaatgagcagtctgaagtctgaggacacagccatgtatcactgtacaagg

SEQ ID NO: 23 - protein, 32 aa, Artificial Sequence
  Mouse E6 heavy chain variable framework region 3 (FWR3) acid sequence
RFTISRDNAKNTLYLQMSSLKSEDTAMYHCTR

SEQ ID NO: 24 - DNA, 39 bp, Artificial Sequence
  Mouse E6 heavy chain variable complementarity determining regions 3 (CDR3) sequence:
gataactacggtaggaactacgactacggtatggactac

SEQ ID NO: 25 - protein, 13 aa, Artificial Sequence
  Mouse E6 heavy chain variable complementarity determining regions 3 (CDR3) sequence:
DNYGRNYDYGMDY

SEQ ID NO: 26-37 - skipped (12 entries)

SEQ ID NO: 38 - DNA, 366 bp, Artificial Sequence
  Humanized E6 heavy chain variable region sequence from IGHV3-21*03
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagc

SEQ ID NO: 39 - protein, 122 aa, Artificial Sequence
  Humanized E6 heavy chain variable region sequence from IGHV3-21*03
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSS

SEQ ID NO: 40 - DNA, 90 bp, Artificial Sequence
  Humanized E6 heavy chain variable framework region 1 (FWR1) acid sequence
gaggtgcagctggtggagtctgggggaggcctggtcaagcctggggggtccctgagactctcctgtgcagcctctggattcaccttcagt

SEQ ID NO: 41 - protein, 30 aa, Artificial Sequence
  Humanized E6 heavy chain variable framework region 1 (FWR1) acid sequence
EVQLVESGGGLVKPGGSLRLSCAASGFTFS

SEQ ID NO: 42 - DNA, 15 bp, Artificial Sequence
  Humanized E6 heavy chain variable complementarity determining regions 1 (CDR1) sequence
aggtatggcatgagc

SEQ ID NO: 43 - protein, 5 aa, Artificial Sequence
  Humanized E6 heavy chain variable complementarity determining regions 1 (CDR1) sequence
RYGMS

SEQ ID NO: 44 - DNA, 42 bp, Artificial Sequence
  Humanized E6 heavy chain variable framework region 2 (FWR2) acid sequence
tgggtccgccaggctccagggaagaggctggagtgggtctca

SEQ ID NO: 45 - protein, 14 aa, Artificial Sequence
  Humanized E6 heavy chain variable framework region 2 (FWR2) acid sequence
WVRQAPGKRLEWVS

SEQ ID NO: 46 - DNA, 51 bp, Artificial Sequence
  Humanized E6 heavy chain variable complementarity determining regions 2 (CDR2) sequence
accattagtggcggaggcacctacatatactacccagactcagtgaagggc

SEQ ID NO: 47 - protein, 17 aa, Artificial Sequence
  Humanized E6 heavy chain variable complementarity determining regions 2 (CDR2) sequence
TISGGGTYIYYPDSVKG

SEQ ID NO: 48 - DNA, 96 bp, Artificial Sequence
  Humanized E6 heavy chain variable framework region 3 (FWR3) acid sequence
cgattcaccatctccagagacaacgccaagaacaccctgtatctgcaaatgaacagcctgagagccgaggacacggctgtgtattactgtaccaga

SEQ ID NO: 49 - protein, 32 aa, Artificial Sequence
  Humanized E6 heavy chain variable framework region 3 (FWR3) acid sequence
RFTISRDNAKNTLYLQMNSLRAEDTAVYYCTR

SEQ ID NO: 50 - DNA, 39 bp, Artificial Sequence
  Humanized E6 heavy chain variable complementarity determining regions 3 (CDR3) sequence
gataactatggccgcaactatgattatggcatggattat

SEQ ID NO: 51 - protein, 13 aa, Artificial Sequence
  Humanized E6 heavy chain variable complementarity determining regions 3 (CDR3) sequence
DNYGRNYDYGMDY

SEQ ID NO: 52 - DNA, 1442 bp, Artificial Sequence
  Humanized E6 IgG2 heavy chain synthesized by Genescript
gaattctaagcttgggccaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaagtttaaactctaga

SEQ ID NO: 53 - protein, 467 aa, Artificial Sequence
  Humanized E6 IgG2 heavy chain synthesized by Genescript
MELGLRWVFLVAILEGVQCEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 54 - DNA, 981 bp, Artificial Sequence
  Human IgG2 heavy chain constant region sequence
gcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatag

SEQ ID NO: 55 - protein, 326 aa, Artificial Sequence
  Human IgG2 heavy chain constant region sequence
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 56 - DNA, 1362 bp, Artificial Sequence
  Humanized E6 IgG1 heavy chain sequence
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacccactgtatctgcaaatgaacagcctgagagccgaggacacggctgtgtattactgtcccagagataactatggccgcaactatgattatggcatggattattggggccagggcaccctggtgaccgtgagcagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 57 - protein, 452 aa, Artificial Sequence
  Humanized E6 IgG1 heavy chain sequence
EVQLVESGGGLVKPGGSLRLSCAASGFTFSRYGMSWVRQAPGKRLEWVSTISGGGTYIYYPDSVKGRFTISRDNAKNPLYLQMNSLRAEDTAVYYCPRDNYGRNYDYGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - DNA, 996 bp, Artificial Sequence
  Human IgG1 heavy chain constant region sequence
gctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 59 - protein, 330 aa, Artificial Sequence
  Human IgG1 heavy chain constant region sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60-64 - skipped (5 entries)

SEQ ID NO: 65 - DNA, 318 bp, Artificial Sequence
  Mouse E6 Light Chain variable region sequence
caaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaa

SEQ ID NO: 66 - protein, 106 aa, Artificial Sequence
  Mouse E6 Light Chain variable region sequence
QIVLTQSPAIMSASPGEEVTLTCSATSSVSYIHWFQQRPGTSPKLWIYSTSNLASGVPVRFSGSGYGTSYSLTISRMEAEDAATYYCQQRSSSPFTFGSGTKLEIK

SEQ ID NO: 67 - DNA, 69 bp, Artificial Sequence
  Mouse E6 light chain variable framework region 1 (FWR1) sequence
caaattgttctcacccagtctccagcaatcatgtctgcatctccaggggaggaggtcaccctaacctgc

SEQ ID NO: 68 - protein, 23 aa, Artificial Sequence
  Mouse E6 light chain variable framework region 1 (FWR1) sequence
QIVLTQSPAIMSASPGEEVTLTC

SEQ ID NO: 69 - DNA, 30 bp, Artificial Sequence
  Mouse E6 light chain variable complementarity determining regions 1 (CDR1) sequence
agtgccacctcaagtgtaagttacatacac

SEQ ID NO: 70 - protein, 10 aa, Artificial Sequence
  Mouse E6 light chain variable complementarity determining regions 1 (CDR1) sequence
SATSSVSYIH

SEQ ID NO: 71 - DNA, 45 bp, Artificial Sequence
  Mouse E6 light chain variable framework region 2 (FWR2) sequence
tggttccagcagaggccaggcacttctcccaaactctggatttat

SEQ ID NO: 72 - protein, 15 aa, Artificial Sequence
  Mouse E6 light chain variable framework region 2 (FWR2) sequence
WFQQRPGTSPKLWIY

SEQ ID NO: 73 - DNA, 21 bp, Artificial Sequence
  Mouse E6 light chain variable complementarity determining regions 2 (CDR2) sequence
agcacatccaacctggcttct

SEQ ID NO: 74 - protein, 7 aa, Artificial Sequence
  Mouse E6 light chain variable complementarity determining regions 2 (CDR2) sequence
STSNLAS

SEQ ID NO: 75 - DNA, 96 bp, Artificial Sequence
  Mouse E6 light chain variable framework region 3 (FWR3) sequence
ggagtccctgttcgcttcagtggcagtggatatgggacctcttactctctcacaatcagccgaatggaggctgaagatgctgccacttattactgc

SEQ ID NO: 76 - protein, 32 aa, Artificial Sequence
  Mouse E6 light chain variable framework region 3 (FWR3) sequence
GVPVRFSGSGYGTSYSLTISRMEAEDAATYYC

SEQ ID NO: 77 - DNA, 27 bp, Artificial Sequence
  Mouse E6 light chain variable complementarity determining regions 3 (CDR3) sequence
cagcaaaggagtagttccccattcacg

SEQ ID NO: 78 - protein, 9 aa, Artificial Sequence
  Mouse E6 light chain variable complementarity determining regions 3 (CDR3) sequence
QQRSSSPFT

SEQ ID NO: 79-92 - skipped (14 entries)

SEQ ID NO: 93 - DNA, 318 bp, Artificial Sequence
  Humanized E6 light chain variable region sequence from IGKV3-11*02
gaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 94 - protein, 106 aa, Artificial Sequence
  Humanized E6 light chain variable region sequence from IGKV3-11*02
EIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 95 - DNA, 69 bp, Artificial Sequence
  Humanized E6 light chain variable framework region 1 (FWR1) acid sequence
gaaattgtgttgacacagtctccagccaccctgtctttgtctccaggggaaagagccaccctcacctgc

SEQ ID NO: 96 - protein, 23 aa, Artificial Sequence
  Humanized E6 light chain variable framework region 1 (FWR1) acid sequence
EIVLTQSPATLSLSPGERATLTC

SEQ ID NO: 97 - DNA, 30 bp, Artificial Sequence
  Humanized E6 light chain variable complementarity determining regions 1 (CDR1) sequence
agcgccaccagcagtgttagctacatccac

SEQ ID NO: 98 - protein, 10 aa, Artificial Sequence
  Humanized E6 light chain variable complementarity determining regions 1 (CDR1) sequence
SATSSVSYIH

SEQ ID NO: 99 - DNA, 45 bp, Artificial Sequence
  Humanized E6 heavy light variable framework region 2 (FWR2) acid sequence
tggtaccaacagaggcctggccagagccccaggctcctcatctat

SEQ ID NO: 100 - protein, 15 aa, Artificial Sequence
  Humanized E6 heavy light variable framework region 2 (FWR2) acid sequence
WYQQRPGQSPRLLIY

SEQ ID NO: 101 - DNA, 21 bp, Artificial Sequence
  Humanized E6 light chain variable complementarity determining regions 2 (CDR2) sequence
agcacctccaacctggccagc

SEQ ID NO: 102 - protein, 7 aa, Artificial Sequence
  Humanized E6 light chain variable complementarity determining regions 2 (CDR2) sequence
STSNLAS

SEQ ID NO: 103 - DNA, 96 bp, Artificial Sequence
  Humanized E6 light chain variable framework region 3 (FWR3) acid sequence
ggcatcccagccaggttcagtggcagtgggtctgggagcgactacactctcaccatcagcagcctagagcctgaagattttgcagtttattactgt

SEQ ID NO: 104 - protein, 32 aa, Artificial Sequence
  Humanized E6 light chain variable framework region 3 (FWR3) acid sequence
GIPARFSGSGSGSDYTLTISSLEPEDFAVYYC

SEQ ID NO: 105 - DNA, 27 bp, Artificial Sequence
  Humanized E6 light chain variable complementarity determining regions 3 (CDR3) sequence
cagcagcgtagcagctcccctttcacc

SEQ ID NO: 106 - protein, 9 aa, Artificial Sequence
  Humanized E6 light chain variable complementarity determining regions 3 (CDR3) sequence
QQRSSSPFT

SEQ ID NO: 107 - DNA, 740 bp, Artificial Sequence
  Humanized E6 Kappa light chain synthesized by Genescript
gaattctaagcttgggccaccatggaagccccagcgcagcttctcttcctcctgctactctggctcccagataccactggagaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaaggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaagtttaaactctaga

SEQ ID NO: 108 - protein, 233 aa, Artificial Sequence
  Humanized E6 Kappa light chain synthesized by Genescript
MEAPAQLLFLLLLWLPDTTGEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - DNA, 324 bp, Artificial Sequence
  Human Kappa light chain constant region sequence
aggacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 110 - protein, 107 aa, Artificial Sequence [sequence omitted]

SEQ ID NO: 111 - DNA, 642 bp, Artificial Sequence
  Humanized E6 lambda light chain sequence
gaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 112 - protein, 212 aa, Artificial Sequence
  Humanized E6 lambda light chain sequence
EIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 113 - DNA, 324 bp, Artificial Sequence
  Humanized lambda light chain constant region sequence
ggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 114 - protein, 106 aa, Artificial Sequence
  Humanized lambda light chain constant region sequence
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 115-117 - skipped (3 entries)

SEQ ID NO: 118 - DNA, 390 bp, Artificial Sequence
  Mouse C2 heavy chain variable region sequence
gaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctat

SEQ ID NO: 119 - protein, 130 aa, Artificial Sequence
  Mouse C2 heavy chain variable region sequence
EVQLEESGGGLVKPGGSLKLSCAASGFTFSGYAMSWVRQTPEKRLEWVATISSGGTYIYYPDSVKGRFTISRDNAKNTLYLQMSSLRSEDTAMYYCARLGGDNYYEYFDVWGAGTTVTVSSAKTTPPSVY

SEQ ID NO: 120 - DNA, 90 bp, Artificial Sequence
  Mouse C2 heavy chain variable framework region 1 (FWR1) sequence
gaggtccagctggaggagtcagggggaggcttagtgaagcctggagggtccctgaaactctcctgtgcagcctctggattcactttcagt

SEQ ID NO: 121 - protein, 30 aa, Artificial Sequence
  Mouse C2 heavy chain variable framework region 1 (FWR1) sequence
EVQLEESGGGLVKPGGSLKLSCAASGFTFS

SEQ ID NO: 122 - DNA, 15 bp, Artificial Sequence
  Mouse C2 heavy chain variable complementarity determining regions 1 (CDR1) sequence
ggctatgccatgtct

SEQ ID NO: 123 - protein, 5 aa, Artificial Sequence
  Mouse C2 heavy chain variable complementarity determining regions 1 (CDR1) sequence
GYAMS

SEQ ID NO: 124 - DNA, 42 bp, Artificial Sequence
  Mouse C2 heavy chain variable framework region 2 (FWR2) sequence
tgggttcgccagactccggagaagaggctggagtgggtcgca

SEQ ID NO: 125 - protein, 14 aa, Artificial Sequence
  Mouse C2 heavy chain variable framework region 2 (FWR2) sequence
WVRQTPEKRLEWVA

SEQ ID NO: 126 - DNA, 51 bp, Artificial Sequence
  Mouse C2 heavy chain variable complementarity determining regions 2 (CDR2) sequence
accattagtagtggtggtacttatatctactatccagacagtgtgaagggg

SEQ ID NO: 127 - protein, 17 aa, Artificial Sequence
  Mouse C2 heavy chain variable complementarity determining regions 2 (CDR2) sequence
TISSGGTYIYYPDSVKG

SEQ ID NO: 128 - DNA, 96 bp, Artificial Sequence
  Mouse C2 heavy chain variable framework region 3 (FWR3) sequence
cgattcaccatctccagagacaatgccaagaacaccctgtacctgcaaatgagcagtctgaggtctgaggacacggccatgtattactgtgcaaga

SEQ ID NO: 129 - protein, 32 aa, Artificial Sequence
  Mouse C2 heavy chain variable framework region 3 (FWR3) sequence
RFTISRDNAKNTLYLQMSSLRSEDTAMYYCAR

SEQ ID NO: 130 - DNA, 36 bp, Artificial Sequence
  Mouse C2 heavy chain variable complementarity determining regions 3 (CDR3) sequence
cttgggggggataattactacgaatacttcgatgtc

SEQ ID NO: 131 - protein, 12 aa, Artificial Sequence
  Mouse C2 heavy chain variable complementarity determining regions 3 (CDR3) sequence
LGGDNYYEYFDV

SEQ ID NO: 132-143 - skipped (12 entries)

SEQ ID NO: 144 - DNA, 363 bp, Artificial Sequence
  Humanized derived from IGHV3-21*04 - Humanized C2 heavy chain variable region sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctcc

SEQ ID NO: 145 - protein, 121 aa, Artificial Sequence
  Humanized C2 heavy chain variable region sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSS

SEQ ID NO: 146 - DNA, 90 bp, Artificial Sequence; identical to SEQ ID NO: 40
  Humanized C2 heavy chain variable framework region 1 (FWR1) sequence

SEQ ID NO: 147 - protein, 30 aa, Artificial Sequence; identical to SEQ ID NO: 41
  Humanized C2 heavy chain variable framework region 1 (FWR1) sequence

SEQ ID NO: 148 - DNA, 15 bp, Artificial Sequence
  Humanized C2 heavy chain variable complementarity determining regions 1 (CDR1) sequence
ggctatgccatgagc

SEQ ID NO: 149 - protein, 5 aa, Artificial Sequence
  Humanized C2 heavy chain variable complementarity determining regions 1 (CDR1) sequence
GYAMS

SEQ ID NO: 150 - DNA, 43 bp, Artificial Sequence
  Humanized C2 heavy chain variable framework region 2 (FWR2) sequence
tgggtccgccaggctccagggaaggggctggagtgggtctcaa

SEQ ID NO: 151 - protein, 14 aa, Artificial Sequence
  Humanized C2 heavy chain variable framework region 2 (FWR2) sequence
WVRQAPGKGLEWVS

SEQ ID NO: 152 - DNA, 51 bp, Artificial Sequence
  Humanized C2 heavy chain variable complementarity determining regions 2 (CDR2) sequence
accattagtagtggcggaacctacatatactaccccgactcagtgaagggc

SEQ ID NO: 153 - protein, 17 aa, Artificial Sequence
  Humanized C2 heavy chain variable complementarity determining regions 2 (CDR2) sequence
TISSGGTYIYYPDSVKG

SEQ ID NO: 154 - DNA, 96 bp, Artificial Sequence
  Humanized C2 heavy chain variable framework region 3 (FWR3) sequence
cgattcaccatctccagagacaacgccaagaactcactgtatctgcaaatgaacagcctgagagccgaggacacggccgtgtattactgtgcgaga

SEQ ID NO: 155 - protein, 32 aa, Artificial Sequence
  Humanized C2 heavy chain variable framework region 3 (FWR3) sequence
RFTISRDNAKNSLYLQMNSLRAEDTAVYYCAR

SEQ ID NO: 156 - DNA, 36 bp, Artificial Sequence; identical to SEQ ID NO: 130
  Humanized C2 heavy chain variable complementarity determining regions 3 (CDR3) sequence

SEQ ID NO: 157 - DNA, 1359 bp, Artificial Sequence
  Description of Artificial Sequence: Synthetic polynucleotide
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 158 - protein, 451 aa, Artificial Sequence
  Humanized C2 IgG1 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159-162 - skipped (4 entries)

SEQ ID NO: 163 - DNA, 1347 bp, Artificial Sequence
  Humanized C2 IgG2 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 164 - protein, 447 aa, Artificial Sequence
  Humanized C2 IgG2 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 165-167 - skipped (3 entries)

SEQ ID NO: 168 - DNA, 360 bp, Artificial Sequence
  Mouse C2 light chain variable region sequence
gacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatcc

SEQ ID NO: 169 - protein, 120 aa, Artificial Sequence
  Mouse C2 light chain variable region sequence
DIVITQSTASLGVSLGQRATISCRASKSVSTSGYSYMHWYQQRPGQPPKLLIYLASNLESGVPARFSGSGSGTDFTLNIHPVEEEDAATYYCQHSRELPFTFGGGTKLEIKRADAAPTVS

SEQ ID NO: 170 - DNA, 69 bp, Artificial Sequence
  Mouse C2 light chain variable framework region 1 (FWR1) sequence
gacattgtgatcacacagtctacagcttccttaggtgtatctctggggcagagggccaccatctcatgc

SEQ ID NO: 171 - protein, 23 aa, Artificial Sequence
  Mouse C2 light chain variable framework region 1 (FWR1) sequence
DIVITQSTASLGVSLGQRATISC

SEQ ID NO: 172 - DNA, 45 bp, Artificial Sequence
  Mouse C2 light chain variable complementarity determining regions 1 (CDR1) sequence
agggccagcaaaagtgtcagtacatctggctatagttatatgcac

SEQ ID NO: 173 - protein, 15 aa, Artificial Sequence
  Mouse C2 light chain variable complementarity determining regions 1 (CDR1) sequence
RASKSVSTSGYSYMH

SEQ ID NO: 174 - DNA, 45 bp, Artificial Sequence
  Mouse C2 light chain variable framework region 2 (FWR2) sequence
tggtaccaacagagaccaggacagccacccaaactcctcatctat

SEQ ID NO: 175 - protein, 15 aa, Artificial Sequence
  Mouse C2 light chain variable framework region 2 (FWR2) sequence
WYQQRPGQPPKLLIY

SEQ ID NO: 176 - DNA, 20 bp, Artificial Sequence
  Mouse C2 light chain variable complementarity determining regions 2 (CDR2) sequence
cttgcatccaacctagaatc

SEQ ID NO: 177 - protein, 7 aa, Artificial Sequence
  Mouse C2 light chain variable complementarity determining regions 2 (CDR2) sequence
LASNLES

SEQ ID NO: 178 - DNA, 97 bp, Artificial Sequence
  Mouse C2 light chain variable framework region 3 (FWR3) sequence
tggggtccctgccaggttcagtggcagtgggtctgggacagacttcaccctcaacatccatcctgtggaggaggaggatgctgcaacctattactgt

SEQ ID NO: 179 - protein, 32 aa, Artificial Sequence
  Mouse C2 light chain variable framework region 3 (FWR3) sequence
GVPARFSGSGSGTDFTLNIHPVEEEDAATYYC

SEQ ID NO: 180 - DNA, 27 bp, Artificial Sequence
  Mouse C2 light chain variable complementarity determining regions 3 (CDR3) sequence
cagcacagtagggagcttccgttcacg

SEQ ID NO: 181 - protein, 9 aa, Artificial Sequence
  Mouse C2 light chain variable complementarity determining regions 3 (CDR3) sequence
QHSRELPFT

SEQ ID NO: 182-193 - skipped (12 entries)

SEQ ID NO: 194 - DNA, 339 bp, Artificial Sequence
  Humanized derived from IGKV73*01 - Humanized C2 light chain variable region sequence
gacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 195 - protein, 113 aa, Artificial Sequence
  Humanized derived from IGKV73*01 - Humanized C2 light chain variable region sequence
DIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 196 - DNA, 69 bp, Artificial Sequence
  Humanized C2 light chain variable framework region 1 (FWR1) acid sequence
gacattgtgctgacccagtctccagcctccttggccgtgtctccaggacagagggccaccatcacctgc

SEQ ID NO: 197 - protein, 23 aa, Artificial Sequence
  Humanized C2 light chain variable framework region 1 (FWR1) acid sequence
DIVLTQSPASLAVSPGQRATITC

SEQ ID NO: 198 - DNA, 45 bp, Artificial Sequence
  Humanized C2 light chain variable complementarity determining regions 1 (CDR1) sequence
agagccagtaagagtgtcagtaccagcggatactcctacatgcac

SEQ ID NO: 199 - protein, 15 aa, Artificial Sequence
  Humanized C2 light chain variable complementarity determining regions 1 (CDR1) sequence
RASKSVSTSGYSYMH

SEQ ID NO: 200 - DNA, 45 bp, Artificial Sequence
  Humanized C2 heavy light variable framework region 2 (FWR2) acid sequence
tggtatcagcagaaaccaggacaacctcctaaactcctgatttac

SEQ ID NO: 201 - protein, 15 aa, Artificial Sequence
  Humanized C2 heavy light variable framework region 2 (FWR2) acid sequence
WYQQKPGQPPKLLIY

SEQ ID NO: 202 - DNA, 21 bp, Artificial Sequence
  Humanized C2 light chain variable complementarity determining regions 2 (CDR2) sequence
ctggcatccaatctggagagc

SEQ ID NO: 203 - protein, 7 aa, Artificial Sequence
  Humanized C2 light chain variable complementarity determining regions 2 (CDR2) sequence
LASNLES

SEQ ID NO: 204 - DNA, 96 bp, Artificial Sequence
  Humanized C2 light chain variable framework region 3 (FWR3) acid sequence
ggggtcccagccaggttcagcggcagtgggtctgggaccgatttcaccctcacaattaatcctgtggaagctaatgatactgcaaattattactgt

SEQ ID NO: 205 - protein, 32 aa, Artificial Sequence
  Humanized C2 light chain variable framework region 3 (FWR3) acid sequence
GVPARFSGSGSGTDFTLTINPVEANDTANYYC

SEQ ID NO: 206 - DNA, 27 bp, Artificial Sequence
  Humanized C2 light chain variable complementarity determining regions 3 (CDR3) sequence
cagcacagtagggagctgcctttcaca

SEQ ID NO: 207 - protein, 9 aa, Artificial Sequence
  Humanized C2 light chain variable complementarity determining regions 3 (CDR3) sequence
QHSRELPFT

SEQ ID NO: 208 - DNA, 27 bp, Artificial Sequence
  Humanized C2 light chain variable complementarity determining regions 3 (CDR3) sequence
ctgcagagtaagaattttcctcccaca

SEQ ID NO: 209 - protein, 9 aa, Artificial Sequence
  Humanized C2 light chain variable complementarity determining regions 3 (CDR3) sequence
LQSKNFPPT

SEQ ID NO: 210-221 - skipped (12 entries)

SEQ ID NO: 222 - DNA, 63 bp, Artificial Sequence
  Murine Ig kappa chain leader sequence
atggagacagacacactcctgctatgggtactgctgctctgggttccaggttccactggtgac

SEQ ID NO: 223 - protein, 21 aa, Artificial Sequence
  Murine Ig kappa chain leader sequence
METDTLLLWVLLLWVPGSTGD

SEQ ID NO: 224 - DNA, 60 bp, Artificial Sequence
  Interleukin2 (IL2) leader sequence
atgtacaggatgcaactcctgtcttgcattgcactaagtcttgcacttgtcacaaacagt

SEQ ID NO: 225 - protein, 20 aa, Artificial Sequence
  Interleukin2 (IL2) leader sequence
MYRMQLLSCIALSLALVTNS

SEQ ID NO: 226 - DNA, 48 bp, Artificial Sequence
  CD33 leader sequence
atgcctcttctgcttctgcttcctctgctttgggctggagctcttgct

SEQ ID NO: 227 - protein, 16 aa, Artificial Sequence
  CD33 leader sequence
MPLLLLLPLLWAGALA

SEQ ID NO: 228 - DNA, 57 bp, Artificial Sequence
  IGHV321*03 leader sequence
atggaactggggctccgctgggttttccttgttgctattttagaaggtgtccagtgt

SEQ ID NO: 229 - protein, 19 aa, Artificial Sequence
  IGHV321*03 leader sequence
MELGLRWVFLVAILEGVQC

SEQ ID NO: 230 - DNA, 60 bp, Artificial Sequence
  IGHV311*02 leader sequence
atggaagccccagcgcagcttctcttcctcctgctactctggctcccagataccactgga

SEQ ID NO: 231 - protein, 20 aa, Artificial Sequence
  IGHV311*02 leader sequence
MEAPAQLLFLLLLWLPDTTG

SEQ ID NO: 232 - DNA, 729 bp, Artificial Sequence
  Humanized E6 single chain GS3
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 233 - protein, 243 aa, Artificial Sequence
  Humanized E6 single chain GS3
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 234 - DNA, 747 bp, Artificial Sequence
  Humanized E6 single chain IgG1noC
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcgataaaacccatactaaaccgccaaaaccggcgccggaactgctgggtggtcctggtaccggtgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 235 - protein, 249 aa, Artificial Sequence
  Humanized E6 single chain IgG1noC
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSDKTHTKPPKPAPELLGGPGTGEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 236 - DNA, 813 bp, Artificial Sequence
  Humanized E6 single chain X4 (linker is IgG1 and IgG2 modified hinge region
gaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcgataaaacccatactaaaccgccaaaaccggcgccggaactgctgggtggtcctggtaccggtactggtggtccgactattaaacctccgaaacctccgaaacctgctccgaacctgctgggtggtccggaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaa

SEQ ID NO: 237 - protein, 271 aa, Artificial Sequence
  Humanized E6 single chain X4 (linker is IgG1 and IgG2 modified hinge region
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSDKTHTKPPKPAPELLGGPGTGTGGPTIKPPKPPKPAPNLLGGPEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIK

SEQ ID NO: 238 - DNA, 747 bp, Artificial Sequence
  Humanized C2 single chain GS3
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 239 - protein, 249 aa, Artificial Sequence
  Humanized C2 single chain GS3
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 240-241 - skipped (2 entries)

SEQ ID NO: 242 - DNA, 831 bp, Artificial Sequence
  Humanized C2 single chain X4 (linker is IgG1 and IgG2 modified hinge region
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccgataaaacccatactaaaccgccaaaaccggcgccggaactgctgggtggtcctggtaccggtactggtggtccgactattaaacctccgaaacctccgaaacctgctccgaacctgctgggtggtccggacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaact

SEQ ID NO: 243 - protein, 277 aa, Artificial Sequence
  Humanized C2 single chain X4 (linker is IgG1 and IgG2 modified hinge region
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSDKTHTKPPKPAPELLGGPGTGTGGPTIKPPKPPKPAPNLLGGPDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRT

SEQ ID NO: 244 - DNA, 744 bp, Artificial Sequence
  Humanized C3 single chain GS3
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcggcggtggcggatccggcggtggcggatccggcggtggcggatccgatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 245 - protein, 248 aa, Artificial Sequence
  Humanized C3 single chain GS3
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSGGGGSGGGGSGGGGSDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 246-247 - skipped (2 entries)

SEQ ID NO: 248 - DNA, 828 bp, Artificial Sequence
  Humanized C3 single chain X4 (linker is IgG1 and IgG2 modified hinge region
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgataaaacccatactaaaccgccaaaaccggcgccggaactgctgggtggtcctggtaccggtactggtggtccgactattaaacctccgaaacctccgaaacctgctccgaacctgctgggtggtccggatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 249 - protein, 276 aa, Artificial Sequence
  Humanized C3 single chain X4 (linker is IgG1 and IgG2 modified hinge region
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSDKTHTKPPKPAPELLGGPGTGTGGPTIKPPKPPKPAPNLLGGPDIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 250 - DNA, 741 bp, Artificial Sequence
  Humanized C8 single chain GS3 (linker is [Gly4Ser1]3
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccggcggtggcggatccggcggtggcggatccggcggtggcggatccgacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaact

SEQ ID NO: 251 - protein, 247 aa, Artificial Sequence
  Humanized C8 single chain GS3 (linker is [Gly4Ser1]3
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSGGGGSGGGGSGGGGSDIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRT

SEQ ID NO: 252-255 - skipped (4 entries)

SEQ ID NO: 256 - DNA, 1509 bp, Artificial Sequence
  pSECTag2 E6 scFVFC
atggagacagacacactcctgctatgggtactgctgctctgggttccaggttccactggtgacgcggcccagccggccgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaagagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 257 - protein, 501 aa, Artificial Sequence
  pSECTag2 E6 scFVFC
METDTLLLWVLLLWVPGSTGDAAQPAEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258-271 - skipped (14 entries)

SEQ ID NO: 272 - DNA, 702 bp, Artificial Sequence
  Human IgG1 Fc sequence
gagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 273 - protein, 232 aa, Artificial Sequence
  Human IgG1 Fc sequence
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - DNA, 666 bp, Artificial Sequence
  Human IgG1 CH2CH3 domain sequence
ccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 275 - protein, 220 aa, Artificial Sequence
  Human IgG1 CH2CH3 domain sequence
PCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - DNA, 327 bp, Artificial Sequence
  Human IgG1 CH3 domain sequence
gggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 277 - protein, 107 aa, Artificial Sequence
  Human IgG1 CH3 domain sequence
GQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278-296 - skipped (19 entries)

SEQ ID NO: 297 - DNA, 1464 bp, Artificial Sequence
  CART E6 CD8/CD8/CD28/CD3z sequence - NCD8lshuMNE6scFvCD8ecd fragment CD8 transmembrane CD28 CD3zetaC
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 298 - protein, 486 aa, Artificial Sequence
  CART E6 CD8/CD8/CD28/CD3z sequence - NCD8lshuMNE6scFvCD8ecd fragment CD8 transmembrane CD28 CD3zetaC
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 299 - skipped

SEQ ID NO: 300 - DNA, 1467 bp, Artificial Sequence
  CART E6 CD8/CD8/41BB/CD3z sequence - NCD8lshuMNE6scFvCD8ecd fragment CD8 transmembrane 41BB CD3zetaC
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 301 - protein, 487 aa, Artificial Sequence
  CART E6 CD8/CD8/41BB/CD3z sequence - NCD8lshuMNE6scFvCD8ecd fragment CD8 transmembrane 41BB CD3zetaC
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - skipped

SEQ ID NO: 303 - DNA, 1590 bp, Artificial Sequence
  CART E6 CD8/CD8/CD28/41BB/CD3z sequence - NCD8lshuMNE6scFvCD8ecd fragment CD8 transmembrane CD28 41BB CD3zetaC
atggccctgcccgtgaccgctttgctgctccccctggcgctgctgctgcacgccgccaggccagaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 304 - protein, 528 aa, Artificial Sequence
  CART E6 CD8/CD8/CD28/41BB/CD3z sequence - NCD8lshuMNE6scFvCD8ecd fragment CD8 transmembrane CD28 41BB CD3zetaC
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 305 - skipped

SEQ ID NO: 306 - DNA, 1608 bp, Artificial Sequence
  CART C2 CD8/CD8/CD28/41BB/CD3z sequence - NCD8lshuMNC2scFvCD8ecd fragment CD8 transmembrane CD28 41BB CD3zetaC
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 307 - protein, 513 aa, Artificial Sequence
  CART C2 CD8/CD8/CD28/41BB/CD3z sequence - NCD8lshuMNC2scFvCD8ecd fragment CD8 transmembrane CD28 41BB CD3zetaC
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308-340 - skipped (33 entries)

SEQ ID NO: 341 - DNA, 729 bp, Artificial Sequence
  Humanized E6 scFV sequence in CAR
gaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaa

SEQ ID NO: 342 - protein, 243 aa, Artificial Sequence; identical to SEQ ID NO: 233
  Humanized E6 scFV sequence in CAR

SEQ ID NO: 343 - DNA, 63 bp, Artificial Sequence
  CD8 leader sequence
atggccctgcccgtgaccgctttgctgctccccctggcgctgctgctgcacgccgccaggcca

SEQ ID NO: 344 - protein, 21 aa, Artificial Sequence
  CD8 leader sequence
MALPVTALLLPLALLLHAARP

SEQ ID NO: 345 - DNA, 135 bp, Artificial Sequence
  CD8 hinge domain sequence
acgacaaccccggcccccagaccaccaacgccagcccccaccatcgccagccaacccctgtctctgagaccagaagcctgtaggcctgccgccggtggagctgtgcacacaagaggactggatttcgcctgtgat

SEQ ID NO: 346 - protein, 45 aa, Artificial Sequence
  CD8 hinge domain sequence
TTTPAPRPPTPAPTIASQPLSLRPEACRPAAGGAVHTRGLDFACD

SEQ ID NO: 347 - DNA, 66 bp, Artificial Sequence
  CD4 hinge domain sequence
tcgggacaggtcctgctggaatccaacatcaaggttctgcccacatggtccaccccggtgcagcca

SEQ ID NO: 348 - protein, 22 aa, Artificial Sequence
  CD4 hinge domain sequence
SGQVLLESNIKVLPTWSTPVQP

SEQ ID NO: 349 - DNA, 45 bp, Artificial Sequence
  CD28 hinge domain sequence
aaacacctttgtccaagtcccctatttcccggaccttctaagccc

SEQ ID NO: 350 - protein, 15 aa, Artificial Sequence
  CD28 hinge domain sequence
KHLCPSPLFPGPSKP

SEQ ID NO: 351-360 - skipped (10 entries)

SEQ ID NO: 361 - DNA, 63 bp, Artificial Sequence
  CD3 zeta transmembrane domain sequence
ctctgctacctgctggatggaatcctcttcatctatggtgtcattctcactgccttgttcctg

SEQ ID NO: 362 - protein, 21 aa, Artificial Sequence
  CD3 zeta transmembrane domain sequence
LCYLLDGILFIYGVILTALFL

SEQ ID NO: 363 - DNA, 72 bp, Artificial Sequence
  CD8 transmembrane domain sequence
atctacatttgggccccgctcgcaggcacatgtggagtgctcctcctctccctggtgattaccctgtactgc

SEQ ID NO: 364 - protein, 24 aa, Artificial Sequence
  CD8 transmembrane domain sequence
IYIWAPLAGTCGVLLLSLVITLYC

SEQ ID NO: 365 - DNA, 66 bp, Artificial Sequence
  CD4 transmembrane domain sequence
atggccctgattgtgctggggggcgtcgccggcctcctgcttttcattgggctaggcatcttcttc

SEQ ID NO: 366 - protein, 22 aa, Artificial Sequence
  CD4 transmembrane domain sequence
MALIVLGGVAGLLLFIGLGIFF

SEQ ID NO: 367 - DNA, 81 bp, Artificial Sequence
  CD28 transmembrane domain sequence
ttttgggtgctggtggtggttggtggagtcctggcttgctatagcttgctagtaacagtggcctttattattttctgggtg

SEQ ID NO: 368 - protein, 27 aa, Artificial Sequence
  CD28 transmembrane domain sequence
FWVLVVVGGVLACYSLLVTVAFIIFWV

SEQ ID NO: 369 - DNA, 81 bp, Artificial Sequence
  41BB transmembrane domain sequence
atcatctccttctttcttgcgctgacgtcgactgcgttgctcttcctgctgttcttcctcacgctccgtttctctgttgtt

SEQ ID NO: 370 - protein, 27 aa, Artificial Sequence
  41BB transmembrane domain sequence
IISFFLALTSTALLFLLFFLTLRFSVV

SEQ ID NO: 371 - DNA, 78 bp, Artificial Sequence
  OX40 transmembrane domain sequence
gttgccgccatcctgggcctgggcctggtgctggggctgctgggccccctggccatcctgctggccctgtacctgctc

SEQ ID NO: 372 - protein, 26 aa, Artificial Sequence
  OX40 transmembrane domain sequence
VAAILGLGLVLGLLGPLAILLALYLL

SEQ ID NO: 373 - DNA, 336 bp, Artificial Sequence
  CD3 zeta domain sequence
cgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacgg

SEQ ID NO: 374 - protein, 112 aa, Artificial Sequence
  CD3 zeta domain sequence
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 375 - DNA, 336 bp, Artificial Sequence
  CD3 zeta domain variant sequence
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 376 - protein, 112 aa, Artificial Sequence
  CD3 zeta domain variant sequence
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 377 - DNA, 123 bp, Artificial Sequence
  CD28 domain sequence
agaagcaagcggtctcggctcctgcattctgattacatgaacatgaccccaagaagaccaggccccaccaggaaacattaccagccctacgctccgccacgcgacttcgctgcctaccggtcc

SEQ ID NO: 378 - protein, 41 aa, Artificial Sequence
  CD28 domain sequence
RSKRSRLLHSDYMNMTPRRPGPTRKHYQPYAPPRDFAAYRS

SEQ ID NO: 379 - DNA, 126 bp, Artificial Sequence
  41BB domain sequence
aaaaggggccgcaaaaaactcctttacatttttaagcagccttttatgaggccagtacagacgactcaagaggaagacgggtgctcatgccgctttcctgaggaggaggaaggagggtgcgaactg

SEQ ID NO: 380 - protein, 42 aa, Artificial Sequence
  41BB domain sequence
KRGRKKLLYIFKQPFMRPVQTTQEEDGCSCRFPEEEEGGCEL

SEQ ID NO: 381-390 - skipped (10 entries)

SEQ ID NO: 391 - DNA, 729 bp, Artificial Sequence; identical to SEQ ID NO: 232
  HumanizeE6 scFV (VHVL) sequence

SEQ ID NO: 392 - protein, 243 aa, Artificial Sequence; identical to SEQ ID NO: 233
  HumanizeE6 scFV (VHVL) sequence

SEQ ID NO: 393 - DNA, 729 bp, Artificial Sequence
  HumanizeE6 scFV (VLVH) sequence
gaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaggcggtggcggatccggcggtggcggatccggcggtggcggatccgaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagc

SEQ ID NO: 394 - protein, 243 aa, Artificial Sequence
  HumanizeE6 scFV (VLVH) sequence
EIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKGGGGSGGGGSGGGGSEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSS

SEQ ID NO: 395 - DNA, 747 bp, Artificial Sequence; identical to SEQ ID NO: 238
  HumanizeC2 scFV (VHVL) sequence

SEQ ID NO: 396 - protein, 249 aa, Artificial Sequence; identical to SEQ ID NO: 239
  HumanizeC2 scFV (VHVL) sequence

SEQ ID NO: 397 - DNA, 747 bp, Artificial Sequence
  HumanizeE6 scFV (VLVH) sequence
gacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactggcggtggcggatccggcggtggcggatccggcggtggcggatccgaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctcc

SEQ ID NO: 398 - protein, 249 aa, Artificial Sequence
  HumanizeE6 scFV (VLVH) sequence
DIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTGGGGSGGGGSGGGGSEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSS

SEQ ID NO: 399 - DNA, 15 bp, Artificial Sequence
  G4S1 linker sequence
ggcggtggcggatcc

SEQ ID NO: 400 - protein, 5 aa, Artificial Sequence
  G4S1 linker sequence
GGGGS

SEQ ID NO: 401 - DNA, 45 bp, Artificial Sequence
  [G4S1]x3 linker sequence
ggcggtggcggatccggcggtggcggatccggcggtggcggatcc

SEQ ID NO: 402 - protein, 15 aa, Artificial Sequence
  [G4S1]x3 linker sequence
GGGGSGGGGSGGGGS

SEQ ID NO: 403 - DNA, 24 bp, Artificial Sequence
  8 aa GS linker sequence
ggcggttccggcggtggatccgga

SEQ ID NO: 404 - protein, 8 aa, Artificial Sequence
  8 aa GS linker sequence
GGSGGGSG

SEQ ID NO: 405 - DNA, 39 bp, Artificial Sequence
  12 aa GS linker sequence
ggcggttccggcggtggatccggcggtggcggatccgga

SEQ ID NO: 406 - protein, 12 aa, Artificial Sequence
  12 aa GS linker sequence
GGSGGGSGGGSG

SEQ ID NO: 407 - DNA, 39 bp, Artificial Sequence
  13 aa GS linker sequence
ggcggtggatccggcggtggcggatccggcggtggatcc

SEQ ID NO: 408 - protein, 13 aa, Artificial Sequence
  13 aa GS linker sequence
GGGSGGGGSGGGS

SEQ ID NO: 409 - DNA, 66 bp, Artificial Sequence
  22 aa GS linker sequence
ggcggtggaagcggcggtggcggatccggcagcggcggaagcggcggtggcggatccggcggtgga

SEQ ID NO: 410 - protein, 22 aa, Artificial Sequence
  22 aa GS linker sequence
GGGSGGGGSGSGGSGGGGSGGG

SEQ ID NO: 411 - DNA, 78 bp, Artificial Sequence
  24 aa GS linker sequence
ggcggttccggcggtggatccggcggtggcggatccggaggcggttccggcggtggatccggcggtggcggatccgga

SEQ ID NO: 412 - protein, 24 aa, Artificial Sequence
  24 aa GS linker sequence
GGSGGGSGGGSGGGSGGGSGGGSG

SEQ ID NO: 413 - DNA, 357 bp, Artificial Sequence
  Mouse C3 Heavy chain variable region sequence
caggtccagctgcagcagtctgggcctgagctggtgaggcctggggtctcagtgaagatttcctgcaagggttccggctacagattcactgattatgctatgaactgggtgaagcagagtcatgcaaagagtctagagtggattggagttattagtactttctctggtaatacaaacttcaaccagaagtttaagggcaaggccacaatgactgtagacaaatcctccagcacagcctatatggaacttgccagattgacatctgaggattctgccatgtattactgtgcaagatcggattactacggcccatactttgactactggggccaaggcaccactctcacagtctcctca

SEQ ID NO: 414 - protein, 119 aa, Artificial Sequence
  Mouse C3 Heavy chain variable region sequence
QVQLQQSGPELVRPGVSVKISCKGSGYRFTDYAMNWVKQSHAKSLEWIGVISTFSGNTNFNQKFKGKATMTVDKSSSTAYMELARLTSEDSAMYYCARSDYYGPYFDYWGQGTTLTVSS

SEQ ID NO: 415 - DNA, 90 bp, Artificial Sequence
  Mouse C3 heavy chain variable framework region 1 (FWR1) sequence
caggtccagctgcagcagtctgggcctgagctggtgaggcctggggtctcagtgaagatttcctgcaagggttccggctacagattcact

SEQ ID NO: 416 - protein, 30 aa, Artificial Sequence
  Mouse C3 heavy chain variable framework region 1 (FWR1) sequence
QVQLQQSGPELVRPGVSVKISCKGSGYRFT

SEQ ID NO: 417 - DNA, 15 bp, Artificial Sequence
  Mouse C3 heavy chain variable complementarity determining regions 1 (CDR1) sequence
gattatgctatgaac

SEQ ID NO: 418 - protein, 5 aa, Artificial Sequence
  Mouse C3 heavy chain variable complementarity determining regions 1 (CDR1) sequence
DYAMN

SEQ ID NO: 419 - DNA, 42 bp, Artificial Sequence
  Mouse C3 heavy chain variable framework region 2 (FWR2) sequence
tgggtgaagcagagtcatgcaaagagtctagagtggattgga

SEQ ID NO: 420 - protein, 14 aa, Artificial Sequence
  Mouse C3 heavy chain variable framework region 2 (FWR2) sequence
WVKQSHAKSLEWIG

SEQ ID NO: 421 - DNA, 51 bp, Artificial Sequence
  Mouse C3 heavy chain variable complementarity determining regions 2 (CDR2) sequence
gttattagtactttctctggtaatacaaacttcaaccagaagtttaagggc

SEQ ID NO: 422 - protein, 17 aa, Artificial Sequence
  Mouse C3 heavy chain variable complementarity determining regions 2 (CDR2) sequence
VISTFSGNTNFNQKFKG

SEQ ID NO: 423 - DNA, 96 bp, Artificial Sequence
  Mouse C3 heavy chain variable framework region 3 (FWR3) acid sequence
aaggccacaatgactgtagacaaatcctccagcacagcctatatggaacttgccagattgacatctgaggattctgccatgtattactgtgcaaga

SEQ ID NO: 424 - protein, 32 aa, Artificial Sequence
  Mouse C3 heavy chain variable framework region 3 (FWR3) acid sequence
KATMTVDKSSSTAYMELARLTSEDSAMYYCAR

SEQ ID NO: 425 - DNA, 30 bp, Artificial Sequence
  Mouse C3 heavy chain variable complementarity determining regions 3 (CDR3) sequence
tcggattactacggcccatactttgactac

SEQ ID NO: 426 - protein, 10 aa, Artificial Sequence
  Mouse C3 heavy chain variable complementarity determining regions 3 (CDR3) sequence
SDYYGPYFDY

SEQ ID NO: 427-438 - skipped (12 entries)

SEQ ID NO: 439 - DNA, 357 bp, Artificial Sequence
  Humanized C3 heavy chain variable region sequence from IGHV118*04
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagc

SEQ ID NO: 440 - protein, 119 aa, Artificial Sequence
  Humanized C3 heavy chain variable region sequence from IGHV118*04
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSS

SEQ ID NO: 441 - DNA, 90 bp, Artificial Sequence
  Humanized C3 heavy chain variable framework region 1 (FWR1) acid sequence
caggttcagctggtgcagtctggagctgaggtgaagaagcctggggcctcagtgaaggtctcctgcaaggcttctggttacacctttacc

SEQ ID NO: 442 - protein, 30 aa, Artificial Sequence
  Humanized C3 heavy chain variable framework region 1 (FWR1) acid sequence
QVQLVQSGAEVKKPGASVKVSCKASGYTFT

SEQ ID NO: 443 - DNA, 15 bp, Artificial Sequence
  Humanized C3 heavy chain variable complementarity determining regions 1 (CDR1) sequence
gactacgccatgaac

SEQ ID NO: 444 - protein, 5 aa, Artificial Sequence
  Humanized C3 heavy chain variable complementarity determining regions 1 (CDR1) sequence
DYAMN

SEQ ID NO: 445 - DNA, 42 bp, Artificial Sequence
  Humanized C3 heavy chain variable framework region 2 (FWR2) acid sequence
tgggtgcgacaggcccctggacaagggcttgagtggatggga

SEQ ID NO: 446 - protein, 14 aa, Artificial Sequence
  Humanized C3 heavy chain variable framework region 2 (FWR2) acid sequence
WVRQAPGQGLEWMG

SEQ ID NO: 447 - DNA, 51 bp, Artificial Sequence
  Humanized C3 heavy chain variable complementarity determining regions 2 (CDR2) sequence
gtgatcagcaccttcagcggtaacacaaacttcaaccagaagttcaagggc

SEQ ID NO: 448 - protein, 17 aa, Artificial Sequence
  Humanized C3 heavy chain variable complementarity determining regions 2 (CDR2) sequence
VISTFSGNTNFNQKFKG

SEQ ID NO: 449 - DNA, 96 bp, Artificial Sequence
  Humanized C3 heavy chain variable framework region 3 (FWR3) acid sequence
agagtcaccatgaccacagacacatccacgagcacagcctacatggagctgaggagcctgagatctgacgacacggccgtgtattactgtgcgaga

SEQ ID NO: 450 - protein, 32 aa, Artificial Sequence
  Humanized C3 heavy chain variable framework region 3 (FWR3) acid sequence
RVTMTTDTSTSTAYMELRSLRSDDTAVYYCAR

SEQ ID NO: 451 - DNA, 30 bp, Artificial Sequence
  Humanized C3 heavy chain variable complementarity determining regions 3 (CDR3) sequence
agcgactactacggcccatacttcgactac

SEQ ID NO: 452 - protein, 10 aa, Artificial Sequence
  Humanized C3 heavy chain variable complementarity determining regions 3 (CDR3) sequence
SDYYGPYFDY

SEQ ID NO: 453 - DNA, 1353 bp, Artificial Sequence
  Humanized C3 IgG1 heavy chain sequence
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 454 - protein, 449 aa, Artificial Sequence
  Humanized C3 IgG1 heavy chain sequence
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 455 - DNA, 1341 bp, Artificial Sequence
  Humanized C3 IgG2 heavy chain sequence
caggttcagctggtgcagtctggagctgaggtgaagaagcctggggcctcagtgaaggtctcctgcaaggcttctggttacacctttaccgactacgccatgaactgggtgcgacaggcccctggacaagggcttgagtggatgggagtgatcagcaccttcagcggtaacacaaacttcaaccagaagttcaagggcagagtcaccatgaccacagacacatccacgagcacagcctacatggagctgaggagcctgagatctgacgacacggccgtgtattactgtgcgagaagcgactactacggcccatacttcgactactggggccagggcaccaccctgaccgtgtccagcgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 456 - protein, 445 aa, Artificial Sequence
  Humanized C3 IgG2 heavy chain sequence
QVQLVQSGAEVKKPGASVKVSCKASGYTFTDYAMNWVRQAPGQGLEWMGVISTFSGNTNFNQKFKGRVTMTTDTSTSTAYMELRSLRSDDTAVYYCARSDYYGPYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 457 - skipped

SEQ ID NO: 458 - DNA, 336 bp, Artificial Sequence
  Mouse C3 Light Chain variable region sequence
gatgttttgatgacccaaactccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcaacagagtggaggctgaggatctgggagtttattactgctttcaaggttcacatgttccattcacgttcggctcggggacaaagttggaaataaaa

SEQ ID NO: 459 - protein, 112 aa, Artificial Sequence
  Mouse C3 Light Chain variable region sequence
DVLMTQTPLSLPVSLGDQASISCRSSQTIVHSNGNTYLEWYLQKPGQSPKLLIYKVSNRFSGVPDRFSGSGSGTDFTLKINRVEAEDLGVYYCFQGSHVPFTFGSGTKLEIK

SEQ ID NO: 460 - DNA, 69 bp, Artificial Sequence
  Mouse C3 light chain variable framework region 1 (FWR1) sequence
gatgttttgatgacccaaactccactctccctgcctgtcagtcttggagatcaagcctccatctcttgc

SEQ ID NO: 461 - protein, 23 aa, Artificial Sequence
  Mouse C3 light chain variable framework region 1 (FWR1) sequence
DVLMTQTPLSLPVSLGDQASISC

SEQ ID NO: 462 - DNA, 48 bp, Artificial Sequence
  Mouse C3 light chain variable complementarity determining regions 1 (CDR1) sequence
agatctagtcagaccattgtacatagtaatggaaacacctatttagaa

SEQ ID NO: 463 - protein, 16 aa, Artificial Sequence
  Mouse C3 light chain variable complementarity determining regions 1 (CDR1) sequence
RSSQTIVHSNGNTYLE

SEQ ID NO: 464 - DNA, 45 bp, Artificial Sequence
  Mouse C3 light chain variable framework region 2 (FWR2) sequence
tggtacctgcagaaaccaggccagtctccaaagctcctgatctac

SEQ ID NO: 465 - protein, 15 aa, Artificial Sequence
  Mouse C3 light chain variable framework region 2 (FWR2) sequence
WYLQKPGQSPKLLIY

SEQ ID NO: 466 - DNA, 21 bp, Artificial Sequence
  Mouse C3 light chain variable complementarity determining regions 2 (CDR2) sequence
aaagtttccaaccgattttct

SEQ ID NO: 467 - protein, 7 aa, Artificial Sequence
  Mouse C3 light chain variable complementarity determining regions 2 (CDR2) sequence
KVSNRFS

SEQ ID NO: 468 - DNA, 96 bp, Artificial Sequence
  Mouse C3 light chain variable framework region 3 (FWR3) sequence
ggggtcccagacaggttcagtggcagtggatcagggacagatttcacactcaagatcaacagagtggaggctgaggatctgggagtttattactgc

SEQ ID NO: 469 - protein, 32 aa, Artificial Sequence
  Mouse C3 light chain variable framework region 3 (FWR3) sequence
GVPDRFSGSGSGTDFTLKINRVEAEDLGVYYC

SEQ ID NO: 470 - DNA, 27 bp, Artificial Sequence
  Mouse C3 light chain variable complementarity determining regions 3 (CDR3) sequence
tttcaaggttcacatgttccattcacg

SEQ ID NO: 471 - protein, 9 aa, Artificial Sequence
  Mouse C3 light chain variable complementarity determining regions 3 (CDR3) sequence
FQGSHVPFT

SEQ ID NO: 472-485 - skipped (14 entries)

SEQ ID NO: 486 - DNA, 342 bp, Artificial Sequence
  Humanized C3 light chain variable region sequence from IGKV229*03
gatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaact

SEQ ID NO: 487 - protein, 114 aa, Artificial Sequence
  Humanized C3 light chain variable region sequence from IGKV229*03
DIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRT

SEQ ID NO: 488 - DNA, 69 bp, Artificial Sequence
  Humanized C3 light chain variable framework region 1 (FWR1) acid sequence
gatattgtgatgacccagactccactctctctgtccgtcacccctggacagccggcctccatctcctgc

SEQ ID NO: 489 - protein, 23 aa, Artificial Sequence
  Humanized C3 light chain variable framework region 1 (FWR1) acid sequence
DIVMTQTPLSLSVTPGQPASISC

SEQ ID NO: 490 - DNA, 47 bp, Artificial Sequence
  Humanized C3 light chain variable complementarity determining regions 1 (CDR1) sequence
ggtctagtcagaccattgtccatagtaatggaaacacctatttggag

SEQ ID NO: 491 - protein, 16 aa, Artificial Sequence
  Humanized C3 light chain variable complementarity determining regions 1 (CDR1) sequence
RSSQTIVHSNGNTYLE

SEQ ID NO: 492 - DNA, 45 bp, Artificial Sequence
  Humanized C3 light chain variable framework region 2 (FWR2) acid sequence
tggtacctgcagaagccaggccagtctccacagctcctgatctat

SEQ ID NO: 493 - protein, 15 aa, Artificial Sequence
  Humanized C3 light chain variable framework region 2 (FWR2) acid sequence
WYLQKPGQSPQLLIY

SEQ ID NO: 494 - DNA, 21 bp, Artificial Sequence
  Humanized C3 light chain variable complementarity determining regions 2 (CDR2) sequence
aaggtttccaaccggttctct

SEQ ID NO: 495 - protein, 7 aa, Artificial Sequence
  Humanized C3 light chain variable complementarity determining regions 2 (CDR2) sequence
KVSNRFS

SEQ ID NO: 496 - DNA, 96 bp, Artificial Sequence
  Humanized C3 light chain variable framework region 3 (FWR3) acid sequence
ggagtgccagataggttcagtggcagcgggtcagggacagatttcacactgaaaatcagccgggtggaggctgaggatgttggggtttattactgc

SEQ ID NO: 497 - protein, 32 aa, Artificial Sequence
  Humanized C3 light chain variable framework region 3 (FWR3) acid sequence
GVPDRFSGSGSGTDFTLKISRVEAEDVGVYYC

SEQ ID NO: 498 - DNA, 27 bp, Artificial Sequence
  Humanized C3 light chain variable complementarity determining regions 3 (CDR3) sequence
ttccaaggtagccacgtgcctttcacc

SEQ ID NO: 499 - protein, 9 aa, Artificial Sequence
  Humanized C3 light chain variable complementarity determining regions 3 (CDR3) sequence
FQGSHVPFT

SEQ ID NO: 500 - DNA, 666 bp, Artificial Sequence
  Humanized C3 lambda light chain sequence
gatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 501 - protein, 220 aa, Artificial Sequence
  Humanized C3 lambda light chain sequence
DIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRTGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 502 - DNA, 666 bp, Artificial Sequence
  Humanized C3 Kappa light chain
gatattgtgatgacccagactccactctctctgtccgtcacccctggacagccggcctccatctcctgcaggtctagtcagaccattgtccatagtaatggaaacacctatttggagtggtacctgcagaagccaggccagtctccacagctcctgatctataaggtttccaaccggttctctggagtgccagataggttcagtggcagcgggtcagggacagatttcacactgaaaatcagccgggtggaggctgaggatgttggggtttattactgcttccaaggtagccacgtgcctttcaccttcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaa

SEQ ID NO: 503 - protein, 220 aa, Artificial Sequence
  Humanized C3 Kappa light chain
DIVMTQTPLSLSVTPGQPASISCRSSQTIVHSNGNTYLEWYLQKPGQSPQLLIYKVSNRFSGVPDRFSGSGSGTDFTLKISRVEAEDVGVYYCFQGSHVPFTFGGGTKVEIKRTTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - skipped

SEQ ID NO: 505 - DNA, 321 bp, Artificial Sequence
  Mouse C8 heavy chain variable region sequence
gaagtgatggtcgtggaaagcggcggtggtctggtaaagccggggggatcccttaagctttcttgcgccgcatccgggttcacgttctccggctatgccatgtcctgggtccgacagactcccgaaaagcgcttggaatgggtggccactatctcctccggggggacgtacatctactaccccgacagtgtgaaaggaagatttacaatatctcgcgacaacgcaaaaaataccttgtatcttcaaatgagctccctgcggtcagaggacactgccatgtactattgcgcccgcctgggcggcgacaattactatgagtat

SEQ ID NO: 506 - protein, 107 aa, Artificial Sequence
  Mouse C8 heavy chain variable region sequence
EVMVVESGGGLVKPGGSLKLSCAASGFTFSGYAMSWVRQTPEKRLEWVATISSGGTYIYYPDSVKGRFTISRDNAKNTLYLQMSSLRSEDTAMYYCARLGGDNYYEY

SEQ ID NO: 507 - DNA, 15 bp, Artificial Sequence
  Mouse C8 heavy chain variable complementarity determining region 1 (CDR1) sequence
ggctatgccatgtcc

SEQ ID NO: 508 - protein, 5 aa, Artificial Sequence
  Mouse C8 heavy chain variable complementarity determining region 1 (CDR1) sequence
GYAMS

SEQ ID NO: 509 - DNA, 51 bp, Artificial Sequence
  Mouse C8 heavy chain variable complementarity determining region 2 (CDR2) sequence
actatctcctccggggggacgtacatctactaccccgacagtgtgaaagga

SEQ ID NO: 510 - protein, 17 aa, Artificial Sequence
  Mouse C8 heavy chain variable complementarity determining region 2 (CDR2) sequence
TISSGGTYIYYPDSVKG

SEQ ID NO: 511 - DNA, 27 bp, Artificial Sequence
  Mouse C8 heavy chain variable complementarity determining region 3 (CDR3) sequence
ctgggcggcgacaattactatgagtat

SEQ ID NO: 512 - protein, 9 aa, Artificial Sequence
  Mouse C8 heavy chain variable complementarity determining region 3 (CDR3) sequence
LGGDNYYEY

SEQ ID NO: 513-524 - skipped (12 entries)

SEQ ID NO: 525 - DNA, 354 bp, Artificial Sequence
  Humanized C8 heavy chain variable region sequence from IGHV321*04
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctcc

SEQ ID NO: 526 - protein, 118 aa, Artificial Sequence
  Humanized C8 heavy chain variable region sequence from IGHV321*04
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSS

SEQ ID NO: 527 - DNA, 90 bp, Artificial Sequence; identical to SEQ ID NO: 40
  Humanized C8 heavy chain variable framework region 1 (FWR1) sequence

SEQ ID NO: 528 - protein, 30 aa, Artificial Sequence; identical to SEQ ID NO: 41
  Humanized C8 heavy chain variable framework region 1 (FWR1) sequence

SEQ ID NO: 529 - DNA, 15 bp, Artificial Sequence
  Humanized C8 heavy chain variable complementarity determining region 1 (CDR1) sequence
ggctatgccatgagc

SEQ ID NO: 530 - protein, 5 aa, Artificial Sequence
  Humanized C8 heavy chain variable complementarity determining region 1 (CDR1) sequence
GYAMS

SEQ ID NO: 531 - DNA, 42 bp, Artificial Sequence
  Humanized C8 heavy chain variable framework region 2 (FWR2) sequence
tgggtccgccaggctccagggaaggggctggagtgggtctca

SEQ ID NO: 532 - protein, 14 aa, Artificial Sequence
  Humanized C8 heavy chain variable framework region 2 (FWR2) sequence
WVRQAPGKGLEWVS

SEQ ID NO: 533 - DNA, 51 bp, Artificial Sequence
  Humanized C8 heavy chain variable complementarity determining region 2 (CDR2) sequence
accattagtagtggcggaacctacatatactaccctgactcagtgaagggc

SEQ ID NO: 534 - protein, 17 aa, Artificial Sequence
  Humanized C8 heavy chain variable complementarity determining region 2 (CDR2) sequence
TISSGGTYIYYPDSVKG

SEQ ID NO: 535 - DNA, 96 bp, Artificial Sequence; identical to SEQ ID NO: 154
  Humanized C8 heavy chain variable framework region 3 (FWR3) sequence

SEQ ID NO: 536 - protein, 32 aa, Artificial Sequence; identical to SEQ ID NO: 155
  Humanized C8 heavy chain variable framework region 3 (FWR3) sequence

SEQ ID NO: 537 - DNA, 27 bp, Artificial Sequence
  Humanized C8 heavy chain variable complementarity determining region 3 (CDR3) sequence
ctgggcggcgataactattatgaatat

SEQ ID NO: 538 - protein, 9 aa, Artificial Sequence
  Humanized C8 heavy chain variable complementarity determining region 3 (CDR3) sequence
LGGDNYYEY

SEQ ID NO: 539 - DNA, 1350 bp, Artificial Sequence
  Humanized C8 IgG1 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccgctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgacagtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgataa

SEQ ID NO: 540 - protein, 448 aa, Artificial Sequence
  Humanized C8 IgG1 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 541 - DNA, 1338 bp, Artificial Sequence
  Humanized C8 IgG2 heavy chain sequence
gaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccctgactcagtgaagggccgattcaccatctccagagacaacgccaagaactcactgtatctgcaaatgaacagcctgagagccgaggacacggccgtgtattactgtgcgagactgggcggcgataactattatgaatattggggcaaagggaccacggtcaccgtctcctccgcctccaccaagggcccatcggtcttccccctggcgccctgctccaggagcacctccgagagcacagccgccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatagtaa

SEQ ID NO: 542 - protein, 444 aa, Artificial Sequence
  Humanized C8 IgG2 heavy chain sequence
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYWGKGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 543 - DNA, 306 bp, Artificial Sequence
  Mouse C8 light chain variable region sequence
gacatcgtcattacgcagacccctgccagtcttgccgtttctctgggccagagggccactatcagttacagggcgagtaagtctgtgagtaccagcggctatagttacatgcattggaaccagcagaaaccgggacagccaccacgcctgcttatttatctggtgtctaatcttgagtccggggtgcccgccaggttcagcggcagcggctctgggaccgacttcacactcaacattcatccagtggaagaagaggacgctgctacatactactgtcaacacattcgggaactgaccaggagtgaa

SEQ ID NO: 544 - protein, 102 aa, Artificial Sequence
  Mouse C8 light chain variable region sequence
DIVITQTPASLAVSLGQRATISYRASKSVSTSGYSYMHWNQQKPGQPPRLLIYLVSNLESGVPARFSGSGSGTDFTLNIHPVEEEDAATYYCQHIRELTRSE

SEQ ID NO: 545 - DNA, 45 bp, Artificial Sequence
  Mouse C8 light chain variable complementarity determining region 1 (CDR1) sequence
agggcgagtaagtctgtgagtaccagcggctatagttacatgcat

SEQ ID NO: 546 - protein, 15 aa, Artificial Sequence
  Mouse C8 light chain variable complementarity determining region 1 (CDR1) sequence
RASKSVSTSGYSYMH

SEQ ID NO: 547 - DNA, 21 bp, Artificial Sequence
  Mouse C8 light chain variable complementarity determining region 2 (CDR2) sequence
ctggtgtctaatcttgagtcc

SEQ ID NO: 548 - protein, 7 aa, Artificial Sequence
  Mouse C8 light chain variable complementarity determining region 2 (CDR2) sequence
LVSNLES

SEQ ID NO: 549 - DNA, 30 bp, Artificial Sequence
  Mouse C8 light chain variable complementarity determining region 3 (CDR3) sequence
caacacattcgggaactgaccaggagtgaa

SEQ ID NO: 550 - protein, 10 aa, Artificial Sequence
  Mouse C8 light chain variable complementarity determining region 3 (CDR3) sequence
QHIRELTRSE

SEQ ID NO: 551-564 - skipped (14 entries)

SEQ ID NO: 565 - DNA, 342 bp, Artificial Sequence
  Humanized C8 light chain variable region sequence from NCBI germline z00023
gacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaact

SEQ ID NO: 566 - protein, 114 aa, Artificial Sequence
  Humanized C8 light chain variable region sequence from NCBI germline z00023
DIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRT

SEQ ID NO: 567 - DNA, 69 bp, Artificial Sequence
  Humanized C8 light chain variable framework region 1 (FWR1) sequence
gacatcgtgatgacccagtctccagactccctggctgtgtctctgggcgagagggccaccatcaactgc

SEQ ID NO: 568 - protein, 23 aa, Artificial Sequence
  Humanized C8 light chain variable framework region 1 (FWR1) sequence
DIVMTQSPDSLAVSLGERATINC

SEQ ID NO: 569 - DNA, 42 bp, Artificial Sequence
  Humanized C8 light chain variable complementarity determining region 1 (CDR1) sequence
agggccagcaagagtgttagcaccagcggctacagctacatg

SEQ ID NO: 570 - protein, 14 aa, Artificial Sequence
  Humanized C8 light chain variable complementarity determining region 1 (CDR1) sequence
RASKSVSTSGYSYM

SEQ ID NO: 571 - DNA, 48 bp, Artificial Sequence
  Humanized C8 light chain variable framework region 2 (FWR2) sequence
cactggtaccagcagaaaccaggacagcctcctaagctgctcatttac

SEQ ID NO: 572 - protein, 16 aa, Artificial Sequence
  Humanized C8 light chain variable framework region 2 (FWR2) sequence
HWYQQKPGQPPKLLIY

SEQ ID NO: 573 - DNA, 21 bp, Artificial Sequence
  Humanized C8 light chain variable complementarity determining region 2 (CDR2) sequence
ctggtgtctaacctggaatcc

SEQ ID NO: 574 - protein, 7 aa, Artificial Sequence
  Humanized C8 light chain variable complementarity determining region 2 (CDR2) sequence
LVSNLES

SEQ ID NO: 575 - DNA, 96 bp, Artificial Sequence
  Humanized C8 light chain variable framework region 3 (FWR3) sequence
ggggtccctgaccgattcagtggcagcgggtctgggacagatttcactctcaccatcagcagcctgcaggctgaagatgtggcagtttattactgt

SEQ ID NO: 576 - protein, 32 aa, Artificial Sequence
  Humanized C8 light chain variable framework region 3 (FWR3) sequence
GVPDRFSGSGSGTDFTLTISSLQAEDVAVYYC

SEQ ID NO: 577 - DNA, 30 bp, Artificial Sequence; identical to SEQ ID NO: 549
  Humanized C8 light chain variable complementarity determining region 3 (CDR3) sequence

SEQ ID NO: 578 - protein, 10 aa, Artificial Sequence
  Humanized C8 light chain variable complementarity determining region 3 (CDR3) sequence
QHIRELTRSE

SEQ ID NO: 579 - DNA, 666 bp, Artificial Sequence
  Humanized C8 Lambda light chain sequence
gacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatagtaa

SEQ ID NO: 580 - protein, 220 aa, Artificial Sequence
  Humanized C8 Lambda light chain sequence
DIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRTGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 581 - DNA, 666 bp, Artificial Sequence
  Humanized C8 Kappa light chain sequence
gacatcgtgatgacccagtctccagactccctggctgtgtctctgggcgagagggccaccatcaactgcagggccagcaagagtgttagcaccagcggctacagctacatgcactggtaccagcagaaaccaggacagcctcctaagctgctcatttacctggtgtctaacctggaatccggggtccctgaccgattcagtggcagcgggtctgggacagatttcactctcaccatcagcagcctgcaggctgaagatgtggcagtttattactgtcaacacattcgggaactgaccaggagtgaattcggcggagggaccaaggtggagatcaaacgaactacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagtaa

SEQ ID NO: 582 - protein, 220 aa, Artificial Sequence
  Humanized C8 Kappa light chain sequence
DIVMTQSPDSLAVSLGERATINCRASKSVSTSGYSYMHWYQQKPGQPPKLLIYLVSNLESGVPDRFSGSGSGTDFTLTISSLQAEDVAVYYCQHIRELTRSEFGGGTKVEIKRTTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 583 - skipped

SEQ ID NO: 584 - DNA, 942 bp, Artificial Sequence
  CART E6 CD8 sequence
gaggtccagctggttgagagtggcggtgggctggttaagcctggcggctccctgcggctgagctgcgccgcgagtggatttactttcagccgatatgggatgagttgggtgcggcaagctcccgggaagaggctggaatgggtctcaacaatctccggggggggcacttacatctattaccccgactcagtcaaggggagatttaccatttcacgagacaacgctaagaataccctgtatttgcagatgaattctctgagagcagaggacacagctgtttactattgtacccgcgacaactatggcaggaactacgactacggtatggactattggggacaagggacattggttacagtgagcagtggcggcgggggcagcggaggaggaggcagcggtggggggggcagcgagatagtgctcacgcagtcacccgcgactctcagtctctcacctggggaacgagctaccctgacgtgctctgctacctcctcagtgtcatatattcactggtatcagcaacggcccgggcagtcccctagattgctcatttatagtacctctaatctggcctcaggtatccctgcacgattttctggatctggttcaggttctgattacaccctcactatctctagcctggagcctgaagactttgccgtttattactgccagcagaggtctagctccccattcacctttgggagtgggaccaaggttgaaattaaaacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgctgataa

SEQ ID NO: 585 - protein, 312 aa, Artificial Sequence
  CART E6 CD8 sequence
EVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYC

SEQ ID NO: 586 - DNA, 960 bp, Artificial Sequence
  CART C2 CD8 CD8 sequence - NCD8lshuMNC2scFvCD8ecd fragment CD8 transmembraneC
gaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgctgataa

SEQ ID NO: 587 - protein, 318 aa, Artificial Sequence
  CART C2 CD8 CD8 sequence - NCD8lshuMNC2scFvCD8ecd fragment CD8 transmembraneC
EVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYC

SEQ ID NO: 588 - DNA, 339 bp, Artificial Sequence
  CD8/41BB sequence - N CD8 transmembrane 41BBC
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgtgataa

SEQ ID NO: 589 - protein, 111 aa, Artificial Sequence
  CD8/41BB sequence - N CD8 transmembrane 41BBC
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 590 - DNA, 336 bp, Artificial Sequence
  CD8/CD28 sequence - N CD8 transmembrane CD28C
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcctgataa

SEQ ID NO: 591 - protein, 110 aa, Artificial Sequence
  CD8/CD28 sequence - N CD8 transmembrane CD28C
TTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRS

SEQ ID NO: 592 - DNA, 549 bp, Artificial Sequence
  CD8/CD3z sequence - N CD8 transmembrane CD3zetaC
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 593 - protein, 181 aa, Artificial Sequence
  CD8/CD3z sequence - N CD8 transmembrane CD3zetaC
TTTPAPRPPTPAPTIASQPLSLRPEACRPAAGGAVHTRGLDFACDIYIWAPLAGTCGVLLLSLVITLYCRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 594 - DNA, 672 bp, Artificial Sequence
  CD8/CD28/CD3z sequence - N CD8 transmembrane CD28 CD3zetaC
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 595 - protein, 222 aa, Artificial Sequence
  CD8/CD28/CD3z sequence - N CD8 transmembrane CD28 CD3zetaC
TTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 596 - DNA, 675 bp, Artificial Sequence
  CD8/41BB/CD3z sequence - N CD8 transmembrane 41BB CD3zetaC
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 597 - protein, 223 aa, Artificial Sequence
  CD8/41BB/CD3z sequence - N CD8 transmembrane 41BB CD3zetaC
TTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 598 - DNA, 798 bp, Artificial Sequence
  CD8/CD28/41BB/CD3z sequence - N CD8 transmembrane CD28 41BB CD3zetaC
acgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtccaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 599 - protein, 264 aa, Artificial Sequence
  CD8/CD28/41BB/CD3z sequence - N CD8 transmembrane CD28 41BB CD3zetaC
TTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 600-607 - skipped (8 entries)

SEQ ID NO: 608 - DNA, 1482 bp, Artificial Sequence
  CART C2 CD8/CD8/CD28/CD3z sequence - NCD8lshuMNC2scFvCD8ecd fragment CD8 transmembrane CD28 CD3zetaC
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcagaagcaagcggtctcggctcctgcattctgattacatgaacatgaccccaagaagaccaggccccaccaggaaacattaccagccctacgctccgccacgcgacttcgctgcctaccggtcccgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 609 - protein, 492 aa, Artificial Sequence
  CART C2 CD8/CD8/CD28/CD3z sequence - NCD8lshuMNC2scFvCD8ecd fragment CD8 transmembrane CD28 CD3zetaC
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 610 - DNA, 1485 bp, Artificial Sequence
  CART C2 CD8/CD8/41BB/CD3z sequence #13 - NCD8lshuMNC2scFvCD8ecd fragment CD8 transmembrane 41BB CD3zetaC
atggccttgccagtgacggccctgctgctgccattggctcttctgttgcacgctgccaggcctgaagtgcagctcgtagagagtggcgggggactggtgaagcccggtggaagcctcagactcagttgcgccgcctcaggtttcactttttcaggttacgccatgtcctgggtaagacaggcaccggggaaaggactcgagtgggtgtctactatcagctcaggaggcacttatatatattatcctgactctgtaaaaggccgatttacgatttctcgcgacaatgcaaagaactccctctacctccaaatgaacagtcttagggcagaagacactgctgtatactattgtgcacgcctcggcggcgacaactactacgagtactttgacgtgtgggggaaagggactaccgtgacagtttcaagcggaggaggtggctcaggtggaggcgggtcaggggggggaggaagtgatattgtgctcacacaatccccagcctccctggctgtgtctcccggccaacgcgctacaattacatgtcgggcctccaaaagcgtgagcaccagcggctacagctacatgcactggtatcaacagaaaccaggacaaccccccaaactgttgatttatctcgcttcaaacttggagtccggcgtgcctgcgcgcttttcagggagtgggagcggcacagattttacgctgactatcaaccccgtagaagcaaacgatacagcgaattattattgtcaacattcccgggaactcccctttacgttcggcgggggcacaaaggtcgaaattaagagaaccacgacaaccccggcccccagaccaccaacgccagcccccaccatcgccagccaacccctgtctctgagaccagaagcctgtaggcctgccgccggtggagctgtgcacacaagaggactggatttcgcctgtgatatctacatttgggccccgctcgcaggcacatgtggagtgctcctcctctccctggtgattaccctgtactgcaaaaggggccgcaaaaaactcctttacatttttaagcagccttttatgaggccagtacagacgactcaagaggaagacgggtgctcatgccgctttcctgaggaggaggaaggagggtgcgaactgcgcgttaagttctcccgatcagccgacgcgcctgcttacaagcagggccagaaccaactgtacaacgagctgaatctcggtagacgggaagagtacgacgtgttggacaaacggagaggccgcgacccagaaatgggcggcaagcctcgcaggaaaaacccccaggagggactgtacaatgagttgcagaaagataagatggcagaagcttatagcgagatcggaatgaagggggaaaggagacgagggaaaggacacgacggcctttatcagggcctgtccacagcaacaaaagatacgtatgacgccctccatatgcaggcacttccaccacggtgataa

SEQ ID NO: 611 - protein, 493 aa, Artificial Sequence
  CART C2 CD8/CD8/41BB/CD3z sequence #13 - NCD8lshuMNC2scFvCD8ecd fragment CD8 transmembrane 41BB CD3zetaC
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 612-619 - skipped (8 entries)

SEQ ID NO: 620 - protein, 43 aa, Artificial Sequence
  MUC1 truncated extra cellular domain sequence
SNIKFRPGSVVVQLTLAFREGTINVHDVETQFNQYKTEAASRY

SEQ ID NO: 621 - protein, 35 aa, Artificial Sequence
  MUC1 truncated extra cellular domain sequence
SVVVQLTLAFREGTINVHDVETQFNQYKTEAASRY

SEQ ID NO: 622 - protein, 24 aa, Artificial Sequence
  MUC1 truncated extra cellular domain sequence
VQLTLAFREGTINVHDVETQFNQY

SEQ ID NO: 623 - protein, 24 aa, Artificial Sequence
  MUC1 truncated extra cellular domain sequence
SNIKFRPGSVVVQLTLAFREGTIN

SEQ ID NO: 624 - DNA, 28 bp, Artificial Sequence
  Primer
attctaagcttgggccaccatggaactg

SEQ ID NO: 625 - DNA, 41 bp, Artificial Sequence
  Primer
tctagagtttaaacttactatttacccggagacagggagag

SEQ ID NO: 626 - DNA, 41 bp, Artificial Sequence
  Primer
agtatggcccagccggccgaggtgcagctggtggagtctgg

SEQ ID NO: 627 - DNA, 26 bp, Artificial Sequence
  Primer
tagaaggcacagtcgaggctgatcag

SEQ ID NO: 628 - DNA, 27 bp, Artificial Sequence
  Primer
attctaagcttgggccaccatggaagc

SEQ ID NO: 629 - DNA, 40 bp, Artificial Sequence
  Primer
tctagagtttaaacttactaacactctcccctgttgaagc

SEQ ID NO: 630 - DNA, 43 bp, Artificial Sequence
  Primer
agtatggcccagccggccgaaattgtgttgacacagtctccag

SEQ ID NO: 631 - DNA, 26 bp, Artificial Sequence
  Primer
tagaaggcacagtcgaggctgatcag

SEQ ID NO: 632 - DNA, 33 bp, Artificial Sequence
  Primer
actgtcatatggaggtgcagctggtggagtctg

SEQ ID NO: 633 - DNA, 37 bp, Artificial Sequence
  Primer
actgtctcgagtttaatttccactttggtgccgctgc

SEQ ID NO: 634 - DNA, 33 bp, Artificial Sequence; identical to SEQ ID NO: 632
  Primer

SEQ ID NO: 635 - DNA, 37 bp, Artificial Sequence
  Primer
actgtaccggttttaatttccactttggtgccgctgc

SEQ ID NO: 636 - DNA, 29 bp, Artificial Sequence
  Primer
cttcttcctcaggagcaagctcaccgtgg

SEQ ID NO: 637 - DNA, 18 bp, Artificial Sequence
  Primer
gagccgtcggagtccagc

SEQ ID NO: 638 - DNA, 18 bp, Artificial Sequence
  Primer
gcacctgaactcctgggg

SEQ ID NO: 639 - DNA, 22 bp, Artificial Sequence
  Primer
tttaatttccactttggtgccg

SEQ ID NO: 640 - DNA, 32 bp, Artificial Sequence
  Primer
cgcggctagcttaagcttggtaccgagggcca

SEQ ID NO: 641 - DNA, 36 bp, Artificial Sequence
  Primer
cgcggcggccgcctgatcagcgggtttaaacttatc

SEQ ID NO: 642 - DNA, 2151 bp, Artificial Sequence
  MMP9 sequence
atgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggacgattacaaggatgacgacgataagtgataa

SEQ ID NO: 643 - protein, 715 aa, Artificial Sequence
  MMP9 sequence
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPEPRPPTTTTPQPTAPPTVCPTGPPTVHPSERPTAGPTGPPSAGPTGPPTAGPSTATTVPLSPVDDACNVNIFDAIAEIGNQLYLFKDGKYWRFSEGRGSRPQGPFLIADKWPALPRKLDSVFEERLSKKLFFFSGRQVWVYTGASVLGPRRLDKLGLGADVAQVTGALRSGRGKMLLFSGRRLWRFDVKAQMVDPRSASEVDRMFPGVPLDTHDVFQYREKAYFCQDRFYWRVSSRSELNQVDQVGYVTYDILQCPEDDYKDDDDK

SEQ ID NO: 644 - DNA, 1062 bp, Artificial Sequence
  MMP9 catalytic domain
atgttccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgattacaaggatgacgacgataagtgataa

SEQ ID NO: 645 - protein, 352 aa, Artificial Sequence
  MMP9 catalytic domain
MFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPWCSTTANYDTDDRFGFCPSERLYTQDGNADGKPCQFPFIFQGQSYSACTTDGRSDGYRWCATTANYDRDKLFGFCPTRADSTVMGGNSAGELCVFPFTFLGKEYSTCTSEGRGDGRLWCATTSNFDSDKKWGFCPDQGYSLFLVAAHEFGHALGLDHSSVPEALMYPMYRFTEGPPLHKDDVNGIRHLYGPRPEPDYKDDDDK

SEQ ID NO: 646 - DNA, 2186 bp, Artificial Sequence
  NFATc1 Promoter (NFATc1P)
aggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacagagccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagagg

SEQ ID NO: 647 - DNA, 4349 bp, Artificial Sequence
  NFATc1PMMP9
aggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacagagccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggtctagagccaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggacgattacaaggatgacgacgataagtgataa

SEQ ID NO: 648 - DNA, 3260 bp, Artificial Sequence
  NFATc1PMMP9cat
aggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacagagccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggtctagagccaccatgttccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgattacaaggatgacgacgataagtgataa

SEQ ID NO: 649 - DNA, 30 bp, Artificial Sequence
  NFAT response element
ggaggaaaaactgtttcatacagaaggcgt

SEQ ID NO: 650 - DNA, 90 bp, Artificial Sequence
  NFAT response element repeats
ggaggaaaaactgtttcatacagaaggcgtggaggaaaaactgtttcatacagaaggcgtggaggaaaaactgtttcatacagaaggcgt

SEQ ID NO: 651 - DNA, 61 bp, Artificial Sequence
  CMV minimal promoter
aggtaggcgtgtacggtgggaggtctatataagcagagctggtttagtgaaccgtcagatc

SEQ ID NO: 652 - DNA, 2326 bp, Artificial Sequence
  NFATREmCMVMMP9
ggaggaaaaactgtttcatacagaaggcgtggaggaaaaactgtttcatacagaaggcgtggaggaaaaactgtttcatacagaaggcgtagatctagactcaggtaggcgtgtacggtgggaggtctatataagcagagctggtttagtgaaccgtcagatctctagagccaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggacgattacaaggatgacgacgataagtgataa

SEQ ID NO: 653 - DNA, 1237 bp, Artificial Sequence
  NFATREmCMVMMP9cat
ggaggaaaaactgtttcatacagaaggcgtggaggaaaaactgtttcatacagaaggcgtggaggaaaaactgtttcatacagaaggcgtagatctagactcaggtaggcgtgtacggtgggaggtctatataagcagagctggtttagtgaaccgtcagatctctagagccaccatgttccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgattacaaggatgacgacgataagtgataa

SEQ ID NO: 654 - DNA, 747 bp, Artificial Sequence; identical to SEQ ID NO: 238
  C2 scFv

SEQ ID NO: 655 - protein, 249 aa, Artificial Sequence; identical to SEQ ID NO: 239
  C2 scFv

SEQ ID NO: 656 - DNA, 72 bp, Artificial Sequence
  CD8 transmembrane domain
atctacatctgggcgcccttggccgggacttgtggggtccttctcctgtcactggttatcaccctttactgc

SEQ ID NO: 657 - protein, 24 aa, Artificial Sequence
  CD8 transmembrane domain
IYIWAPLAGTCGVLLLSLVITLYC

SEQ ID NO: 658 - DNA, 126 bp, Artificial Sequence
  41BB domain
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 659 - protein, 42 aa, Artificial Sequence; identical to SEQ ID NO: 380
  41BB domain

SEQ ID NO: 660 - DNA, 336 bp, Artificial Sequence
  CD3zeta domain
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 661 - protein, 112 aa, Artificial Sequence; identical to SEQ ID NO: 374
  CD3zeta domain

SEQ ID NO: 662-717 - skipped (56 entries)

SEQ ID NO: 718 - DNA, 1485 bp, Artificial Sequence
  CART C2 CD8/CD8/41BB/CD3z #44 - NCD8lshuMNC2scFvCD8ecd fragment CD8 transmembrane 41BB CD3zetaC
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 719 - protein, 493 aa, Artificial Sequence; identical to SEQ ID NO: 611
  CART C2 CD8/CD8/41BB/CD3z #44 - NCD8lshuMNC2scFvCD8ecd fragment CD8 transmembrane 41BB CD3zetaC

SEQ ID NO: 720-773 - skipped (54 entries)

SEQ ID NO: 774 - DNA, 3829 bp, Artificial Sequence
  NFATc1P2MMP9
caggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacaggccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcggaagcttctctcgacattcgtttctagagccaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggacgattacaaggatgacgacgataagtgataa

SEQ ID NO: 775 - DNA, 2794 bp, Artificial Sequence
  NFATc1P2MMP9cat
caggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacaggccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcggaagcttctctcgacattcgtttctagagccaccatgagcctctggcagcccctggtcctggtgctcctggtgctgggctgctgctttgctttccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgattacaaggatgacgacgataagtgataa

SEQ ID NO: 776 - DNA, 32 bp, Artificial Sequence
  NFAT response element 2
aagaggaaaatttgtttcatacagaaggcgtt

SEQ ID NO: 777 - DNA, 128 bp, Artificial Sequence
  NFAT response element 2 repeats
aagaggaaaatttgtttcatacagaaggcgttaagaggaaaatttgtttcatacagaaggcgttaagaggaaaatttgtttcatacagaaggcgttaagaggaaaatttgtttcatacagaaggcgtt

SEQ ID NO: 778 - DNA, 118 bp, Artificial Sequence
  CMV minimal promoter 2
taggcgtgtacggtgggaggcctatataagcagagctcgtttagtgaaccgtcagatcgcctggagacgccatccacgctgttttgacctccatagaagacaccgggaccgatccagc

SEQ ID NO: 779 - DNA, 2430 bp, Artificial Sequence
  NFATRE2mCMV2MMP9
aagaggaaaatttgtttcatacagaaggcgttaagaggaaaatttgtttcatacagaaggcgttaagaggaaaatttgtttcatacagaaggcgttaagaggaaaatttgtttcatacagaaggcgttactagttaggcgtgtacggtgggaggcctatataagcagagctcgtttagtgaaccgtcagatcgcctggagacgccatccacgctgttttgacctccatagaagacaccgggaccgatccagcctctcgacattcgtttctagagccaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggaagtactggcgattctctgagggcagggggagccggccgcagggccccttccttatcgccgacaagtggcccgcgctgccccgcaagctggactcggtctttgaggagcggctctccaagaagcttttcttcttctctgggcgccaggtgtgggtgtacacaggcgcgtcggtgctgggcccgaggcgtctggacaagctgggcctgggagccgacgtggcccaggtgaccggggccctccggagtggcagggggaagatgctgctgttcagcgggcggcgcctctggaggttcgacgtgaaggcgcagatggtggatccccggagcgccagcgaggtggaccggatgttccccggggtgcctttggacacgcacgacgtcttccagtaccgagagaaagcctatttctgccaggaccgcttctactggcgcgtgagttcccggagtgagttgaaccaggtggaccaagtgggctacgtgacctatgacatcctgcagtgccctgaggacgattacaaggatgacgacgataagtgataa

SEQ ID NO: 780 - DNA, 1401 bp, Artificial Sequence
  NFATRE2mCMV2MMP9cat
aagaggaaaatttgtttcatacagaaggcgttaagaggaaaatttgtttcatacagaaggcgttaagaggaaaatttgtttcatacagaaggcgttaagaggaaaatttgtttcatacagaaggcgttactagttaggcgtgtacggtgggaggcctatataagcagagctcgtttagtgaaccgtcagatcgcctggagacgccatccacgctgttttgacctccatagaagacaccgggaccgatccagcctcgagctctcgacattcgtttctagagccaccatgagcctctggcagcccctggtcctggtgctcctggtgctgggctgctgctttgctttccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtcctcgccctgaacctgattacaaggatgacgacgataagtgataa

SEQ ID NO: 781 - DNA, 2238 bp, Artificial Sequence
  NFATc1 Promoter fragment (P1)
aggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacagagccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgg

SEQ ID NO: 782 - DNA, 2186 bp, Artificial Sequence; identical to SEQ ID NO: 646
  NFATc1 Promoter fragment (P2)

SEQ ID NO: 783 - DNA, 1645 bp, Artificial Sequence
  NFATc1 Promoter fragment (P3)
caggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacaggccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgg

SEQ ID NO: 784 - DNA, 927 bp, Artificial Sequence
  pNFATMMP9cat1 gBLOCK sequence
aagaggaaaatttgtttcatacagaaggcgttactagttaggcgtgtacggtgggaggcctatataagcagagctcgtttagtgaaccgtcagatcgcctggagacgccatccacgctgttttgacctccatagaagacaccgggaccgatccagcctctcgacattcgtttctagagccaccatgagcctctggcagcccctggtcctggtgctcctggtgctgggctgctgctttgctttccaaacctttgagggcgacctcaagtggcaccaccacaacatcacctattggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcggagcacggagacgggtatcccttcgacgggaaggacgggctcctggcacacgcctttcctcctggccccggcattcagggagacgcccatttcgacgatgacgagttgtggtccctgggcaagggcgtcgtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagactctacacccaggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgagctgactcg

SEQ ID NO: 785-803 - skipped (19 entries)

SEQ ID NO: 804 - DNA, 9 bp, Artificial Sequence
  NFAT consensus sequence
  modified_base (7)..(7): a, c, t, g, unknown or other
  modified_base (9)..(9): a, c, t, g, unknown or other
wggaaanhn

SEQ ID NO: 805 - DNA, 32 bp, Artificial Sequence; identical to SEQ ID NO: 776
  Current NFAT RE (Form System Biosciences. The sequence is from the mouse IL2 promoter.)

SEQ ID NO: 806 - DNA, 812 bp, Artificial Sequence
  Mouse IL2 Promoter (highlighted in green the NFAT RE used, highlighted in yellow is the start codon)
aactagagacatataaaataacaccaacatccttagatacaacccttcctgagaatttattggacatcatactctttttaaaaagcataataaacatcaagacacttacacaaaatatgttaaattaaatttaaaacaacaacgacaaaatagtacctcaagctcaacaagcattttaggtgtccttagcttactatttctctggctaactgtatgaagccatctatcaccctgtgtgcaattagctcattgtgtagataagaaggtaaaaccatcttgaaacaggaaaccaatatccttcctgtctaatcaacaaatctaaaagatttattcttttcatctatctcctcttgcgtttgtccaccacaacaggctgcttacaggttcaggatggttttgacaaagagaacattttcatgagttacttttgtgtctccaccccaaagaggaaaatttgtttcatacagaaggcgttcattgtatgaattaaaactgccacctaagtgtgggctaacccgaccaagagggatttcacctaaatccattcagtcagtgtatgggggtttaaagaaattccagagagtcatcagaagaggaaaaacaaaaggtaatgctttctgccacacaggtagactctttgaaaatatgtgtaatatgtaaaacatcgtgacacccccatattatttttccagcattaacagtataaattgcctcccatgctgaagagctgcctatcacccttgctaatcactcctcacagtgacctcaagtcctgcaggcatgtacagcatgcagctcgcatcctgtgtcac

SEQ ID NO: 807 - DNA, 30 bp, Artificial Sequence; identical to SEQ ID NO: 649
  NFAT RE (Form PRomega. The sequence is from the humane IL2 promoter.)

SEQ ID NO: 808 - DNA, 33 bp, Artificial Sequence
  Possible NFAT RE from ET1 promoter
tccagggaaaatcggagtagaacaagagggatg

SEQ ID NO: 809 - DNA, 34 bp, Artificial Sequence
  Possible NFAT RE from ET1 promoter
actgttggaaaacgtaaacacgttattaaacggt

SEQ ID NO: 810 - DNA, 20 bp, Artificial Sequence
  Possible NFAT RE from human CD3?
tccttaacggaaaaacaaaa

SEQ ID NO: 811 - DNA, 20 bp, Artificial Sequence
  Possible NFAT RE from human CD3?
aaaggaaaaagtatatgttc

SEQ ID NO: 812 - DNA, 17 bp, Artificial Sequence
  Possible NFAT RE from human IL3 promoter
atgccatggaaagggtg

SEQ ID NO: 813 - DNA, 22 bp, Artificial Sequence
  Possible NFAT RE from human GPC6
aaggggaaatgttgagtctaga

SEQ ID NO: 814 - DNA, 17 bp, Artificial Sequence
  Possible NFAT RE from human growth hormonereleasing hormone
aacttggaaaagcatag

SEQ ID NO: 815 - DNA, 5320 bp, Artificial Sequence
  NFATc1 promoter large
ttatgccgtctagaggagacatactttctactcaaagctacacacatagactacaacgatgggaaaagacgacacaccaacagcgacttcaggaaagctggagtggctgctaatgttagacaaaataggctttttaaaaaaggttttattaaagaggaatgtttcgtaatgataaaagcactaatctgtgagaaagatacaacaatgataaacatacgtgcagctaataagagagctccaaaatctatgaagcaaaaactcacagaatgaggggagaagcagttctacaacagagaatggggacttcgatactccactttcaataatggatacaacaaccaggcagataacaaggcaacagaaggcctgaacaacagtataaaccaattagacctaccagatatctatagctagcacactccacccaacgacagcagaatacacattcttctcaagcgcacaagtaacatcctccaggatgggccatgttctaggccatcaaacaaactcaggtggtttgaggccagaggcctctcttttaaccaccacactagggccttcggaggaggcaagcagagagttgtcaaagaggccctcaggactgggtgcagtggctcatgactgtaatcccagcactttagaaggctgaggcacaaggatcttttgagctcaggagttcaagaaatgagcacttatccactgggcgcggtggctcacgccagtaatccagcactttgggaggcttaggcgggcggatcaagaggtcagaagctcaagaccagcctgaccaacatggtgaaaccccgtctctactaaaagtacaaaaattagccgggcgtggtggcgcacacctgtaatcccagctacttgggaggctgaggcaggagaatcacttgaacccgggaggtggaggttgcagtgagtggagatcacaccattgcaccccagcctgggcaacagagcgagactccgtctcaaaaaaaaaaaaaaaaaaaaagaaagaaagaaaaagaaaaaaaaagtgagcatgtattttgccagagtctggagattagaattaaattagcaaaccagaattatagaaaaagctatttacttttaagtaaacagctgagatttttttttttaagtcagtgtgaatgaagctcacagccatggttggagctgagaaagaaggatttccctttagttatgcacctgtgtcagcaccttctgactttccttctaaagtctggggtgttcctgaggatccgtaagtttggggttcagggtttctacagcatgctgttacttgtgaaacatctctttaaccatgtcccagagttgcccaggagtttaagaccagcctgagcaacatagcaagacctcatctcaacaacaacaaaaattagaaataaattagccaggtgtggtgacatgtgcctgtagtcccagctactcagaaggctgaggcatgaggatcacttgggcccaggaagttggggctgcagggagccctgttcatgccgctgcactccagcctgcaagacagagcagaaaaaaagaatcaggatcctgggcagagggaggagaggggaccggggtccagcaagcacttggggattgactgaatggcgttggggagagatgactccaaagtcctggagtgggtgagaatgactgcgagtggcttttaggtggggaggttcctgcctggccactccgggaggggacgtggggctgaagggtatcaggtgccgtgctgagcagtttggccttgatcctaatgccctggacacacgtctagggtaggaaagttgactgatccattggtgatctgagtttttagacatggtggtagtccatgaggtgggtgttcatgctaagagtttagacagggaaacctatgaagcccttagcaaccctccagggaaggggcgtggttaaagagatgtttcataagtaacagcatggtatagaaactctgaaccccaaatgtatgggtcctcaggaacaccccagactttagaaggaaagtcagaaggtgctgacacgggtgtataactaaagggaaatccttctttctcagctccaaccatggctgtgaggttcattcacactgacttaaaaaaaaaaatctcagtttacttaaaagtaaatagctttttctataattctggtttgctaatttaatcctagtctccagaccctggctaaataaatgcccatttctccagatggtctcaagagtctctggacatcgtgggggcccttccctgttggttggaaggtgcctcaggaagaagggggtggattctgagttgagtcaaaacctcaaagacccctgatgggaaaagctctcaagtgaccaccgctgtgggccagaatgcaaaactgcaggaacagaacattcgcaggaacagaacacagtcgtattaagtgattttcccgagcaggaagtggcatctggcctgcggttcagtagggggaggaaagggtgggcgcacctgcccctggctggcgcacctgccaggtagccccacgcggcaccgcgtgtgccgagcgcccctgaggatggaaagccccacgcggggcaggtggcacccaccctccgaagacgggacgggatggagcgttgagcttcggggcagctccggcccggcccgcgctggagacgcccgcatctgccaggatggcgtctcatagccctggtgctcacacatgacgccaggaagccccagcaacagtgaccgcccaggctctagaaaatattggacggggtggatgaacacccaagtgcgctccaggagaagggatttggcaccccaaggggcttttaaaacggtaagcttctaggggtgtctttgcccccaataatccatagaaacaacagtcatctaaaaatagtcttgttttctgtcctaagctccttttaactttgttagtcatcaccaatcctaaaataaaacccgtgtaacgtctcccctagtagcggctataaacaaacctacgaggaggcaggaggaagaggaaaggggcgcagggcgctcggggagcagagccgggggcccgcggtggccgcagaggccgggccggggcgcagaggccgggcgagctggccgcgctctgggccgccgcctccggaactccctgcgcctggcgcgcggccaccgtggtcccggcaacggcattaaacagagggaaacagacccgggattccgtcacccgggcggggggataaggacggctttgagagcagacaggaaaagggagcttttctgcatggggtgaaaaaattatttattgaaggaggaggaggcggcagcggaggaaggggaggggcgggaggaggaggaagagccggccgcccccgccccggccccggctcctcaggagccaagggcagcctcgccaggtcggtcccgggctcgaggaccgcggctggggtcgaggggctcagtctcccacgtgaccggctgggcgcgccccgccagacccggcctcgggattccctcctcccggcgagtctccgcccgccccgtcctggaggtggggagaaggagggcggggcgggggggacggaaactctccccgccaaatcctggccccaggcctggggacactcgcggcgggaagatttggaggggaggggagggggaggggcgtgggggcgcggcctcgctggagtccccctgaccccccgacccccgcccaccggcctgggcgtcctcccgcggcccctcctcccctcccggcgcccggtgctctggggcgcgtgccacgcctggctcggcgccgtaggggcccccgcaggtagagacccctggaaatggcctcgacgccgcaggagcgaggcggccaccaccccgctaatccgggcacgtctctccaggccgaggcctgcggtggaaaagccggggttccatttgtgctgagtcggggcggccgaatggagccaggcctcgggacgcgggacggacgggctctggccgcgcaccttcgcgggctctgcagcgcccgaccgcctcccccggcagggaggaggcgcttgtggggggcacccacggggcacagtgatccctgggggtctgcggacctcctgggccccgcagcagacacgagtttagcctttgggtttagtttaaatcacataagggtgtcgtgcaatcgatttatggtttctacacaccagacactttaacctccaaccccccccatccaaagccaacaagaaaatgcggtgccgtgttggcagctgagctgcgcccgaagagacgcagggagacgtaagagaggaaagtgtgagtggccggggggcctccccccgtcagaagtcgcgcagtcgcgcccataaaacgccccctccgggcggctagggcaggtgagcgcgtccccgggcctccccacgccggcccctgccacaggccgtctaggtcgagcagatatttacagaataaaaatgacaataactcgacgtcccgggacggccacgcaatctgttagtaatttagcgggatgggaatttcctttctagggcctgccagtgaagcgcttttccaaatttccacagcgggggaagcctgcgattttacataatgacttcagcatgccgggctttctcgacacccctccccggcccccggcccccgccccccgccccttttccagcagggccgggctccctccggacacccgcgtggactcaggcgtcccgtctggcccgttcgcccccgtttcccccgccagccccagcgcccccctgcccggcccccggattccccgttcccgcccctacgcccccatcccctccccgtgcgcccctccccgtgcgcccccctccccgtgcgccccccctccccgtgcgcccccctccccgtgcgccccccctccccgggcgcccccctccccgggcgccccccctccccgtgcgcccccccctccccgtgcgccccccctccccgtgcgcgccccgcctcttgcgcccctgcccccaggcgagcggctgccgcggcgcggggaggggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctcggagccaccgcgcaggtcctagggccgcggccgggccccgccacgcgcgcacacgcccctcgatg

SEQ ID NO: 816 - DNA, 361 bp, Artificial Sequence
  NFATc3 promoter sequence
gcagccaggcagggtgggcgcgcgtagggggcggggccgggcgcgcggcagggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccg

SEQ ID NO: 817 - DNA, 430 bp, Artificial Sequence
  NFATc2 promoter sequence 1
cagagagaggctgcgttcagactggggcactgccatcccctccgcatcatggggtctgtggaccaaggtaactgactctcgatcccttccagccttttccgctcgctcctcccggccctttcctgctgctcccgtcccgggcagcactttcagctcccggcagaggtcggtgcgggaggcctggggaccccgctcgccctcggcgcacaggtagcggggcccgcggaggggcgcccgcgccccggccagggaagggacacttgggaaggcgactttggacaactttacgcgggggcagggaagtgtcccaggccgggattccctaggccagtctgtcgggaggattttcctctccacgggacaccgggagggattctcgctactaaccgctggctgtttaaccgtttcagcactcggcttttgacagcaa

SEQ ID NO: 818 - DNA, 64 bp, Artificial Sequence
  NFATc2 promoter sequence 2
catcatggggtctgtggaccaaggtaactgactctcgatcccttccagccttttccgctcgctc

SEQ ID NO: 819 - DNA, 12 bp, Artificial Sequence
  NFATc1 response element consensus
cattttttccat

SEQ ID NO: 820 - DNA, 8 bp, Artificial Sequence
  NFATc1 response element consensus
tttttcca

SEQ ID NO: 821 - DNA, 119 bp, Artificial Sequence
  NFAT response elements contained within the Foxp3 enhancer region
acttgaaaatgagataaatgttcacctatgttggcttctagtctcttttatggcttcattttttccatttactatagaggttaagagtgtgggtactggagccagactgtctgggacaa

SEQ ID NO: 822 - protein, 65 aa, Artificial Sequence
  N+20
SNIKFRPGSVVVQLTLAFREGTINVHDVETQFNQYKTEAASRYNLTISDVSVSDVPFPFSAQSGA

SEQ ID NO: 823 - protein, 38 aa, Artificial Sequence
  N+20/C27
SNIKFRPGSVVVQLTLAFREGTINVHDVETQFNQYKTE

SEQ ID NO: 824 - protein, 45 aa, Artificial Sequence
  N+9/C9
VQLTLAFREGTINVHDVETQFNQYKTEAASRYNLTISDVSVSDVP

SEQ ID NO: 825 - protein, 35 aa, Artificial Sequence
  C10
GTINVHDVETQFNQYKTEAASRYNLTISDVSVSDV

SEQ ID NO: 826 - DNA, 885 bp, Artificial Sequence
  NME7AB
atggaaaaaacgctggccctgattaaaccggatgcaatctccaaagctggcgaaattatcgaaattatcaacaaagcgggtttcaccatcacgaaactgaaaatgatgatgctgagccgtaaagaagccctggattttcatgtcgaccaccagtctcgcccgtttttcaatgaactgattcaattcatcaccacgggtccgattatcgcaatggaaattctgcgtgatgacgctatctgcgaatggaaacgcctgctgggcccggcaaactcaggtgttgcgcgtaccgatgccagtgaatccattcgcgctctgtttggcaccgatggtatccgtaatgcagcacatggtccggactcattcgcatcggcagctcgtgaaatggaactgtttttcccgagctctggcggttgcggtccggcaaacaccgccaaatttaccaattgtacgtgctgtattgtcaaaccgcacgcagtgtcagaaggcctgctgggtaaaattctgatggcaatccgtgatgctggctttgaaatctcggccatgcagatgttcaacatggaccgcgttaacgtcgaagaattctacgaagtttacaaaggcgtggttaccgaatatcacgatatggttacggaaatgtactccggtccgtgcgtcgcgatggaaattcagcaaaacaatgccaccaaaacgtttcgtgaattctgtggtccggcagatccggaaatcgcacgtcatctgcgtccgggtaccctgcgcgcaatttttggtaaaacgaaaatccagaacgctgtgcactgtaccgatctgccggaagacggtctgctggaagttcaatactttttcaaaattctggataatctcgagcaccaccaccaccaccactga

SEQ ID NO: 827 - protein, 294 aa, Artificial Sequence
  NME7AB
MEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDNLEHHHHHH

SEQ ID NO: 828 - DNA, 783 bp, Artificial Sequence
  Human NME7 x1
atgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataatctcgagcaccaccaccaccaccactga

SEQ ID NO: 829 - protein, 260 aa, Artificial Sequence
  Human NME7 x1
MMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDNLEHHHHHH

SEQ ID NO: 830 - DNA, 426 bp, Artificial Sequence
  Mouse Antibody 17H6 Heavy chain: DNA sequence - Signal sequence FR1CDR1FR2CDR2FR3CDR3FR4
atgaagttgtggctgaactggattttccttgtaacacttttaaatggtatccagtgtgaggtgaagctggtggagtctggaggaggcttggtacagcctgggggttctctgagactctcctgtgcaacttctgggttcaccttcactgattactacatgagctgggtccgccagcctccaagaaaggcacttgagtggttgggttttattagaaacaaagctaatggttacacagcagagtacagtgcgtctgtgaagggtcggttcaccatctccagagatgtttcccaaaacctcctctatcttcaaatgaacatcctgagagctgaggacagtgccacttattactgtgcaaaagattactacggtagtaaccctgcctggtttgcttactggggccaagggactctggtcactgtctctgca

SEQ ID NO: 831 - protein, 142 aa, Artificial Sequence
  Mouse Antibody 17H6 Heavy chain: Amino acid sequence - Signal peptideFR1CDR1FR2CDR2FR3CDR3FR4
MKLWLNWIFLVTLLNGIQCEVKLVESGGGLVQPGGSLRLSCATSGFTFTDYYMSWVRQPPRKALEWLGFIRNKANGYTAEYSASVKGRFTISRDVSQNLLYLQMNILRAEDSATYYCAKDYYGSNPAWFAYWGQGTLVTVSA

SEQ ID NO: 832 - DNA, 90 bp, Artificial Sequence
  Mouse 17H6 heavy chain variable framework 1 (FW1) sequence
gaggtgaagctggtggagtctggaggaggcttggtacagcctgggggttctctgagactctcctgtgcaacttctgggttcaccttcact

SEQ ID NO: 833 - protein, 30 aa, Artificial Sequence
  Mouse 17H6 heavy chain variable framework 1 (FW1) sequence
EVKLVESGGGLVQPGGSLRLSCATSGFTFT

SEQ ID NO: 834 - DNA, 15 bp, Artificial Sequence
  Mouse 17H6 heavy chain variable complementarity determining regions 1 (CDR1) sequence
gattactacatgagc

SEQ ID NO: 835 - protein, 5 aa, Artificial Sequence
  Mouse 17H6 heavy chain variable complementarity determining regions 1 (CDR1) sequence
DYYMS

SEQ ID NO: 836 - DNA, 90 bp, Artificial Sequence; identical to SEQ ID NO: 832
  Mouse 17H6 heavy chain variable framework 2 (FW2) sequence

SEQ ID NO: 837 - protein, 14 aa, Artificial Sequence
  Mouse 17H6 heavy chain variable framework 2 (FW2) sequence
WVRQPPRKALEWLG

SEQ ID NO: 838 - DNA, 57 bp, Artificial Sequence
  Mouse 17H6 heavy chain variable complementarity determining regions 2 (CDR2) sequence
tttattagaaacaaagctaatggttacacagcagagtacagtgcgtctgtgaagggt

SEQ ID NO: 839 - protein, 19 aa, Artificial Sequence
  Mouse 17H6 heavy chain variable complementarity determining regions 2 (CDR2) sequence
FIRNKANGYTAEYSASVKG

SEQ ID NO: 840 - DNA, 96 bp, Artificial Sequence
  Mouse 17H6 heavy chain variable framework 3 (FW3) sequence
cggttcaccatctccagagatgtttcccaaaacctcctctatcttcaaatgaacatcctgagagctgaggacagtgccacttattactgtgcaaaa

SEQ ID NO: 841 - protein, 32 aa, Artificial Sequence
  Mouse 17H6 heavy chain variable framework 3 (FW3) sequence
RFTISRDVSQNLLYLQMNILRAEDSATYYCAK

SEQ ID NO: 842 - DNA, 36 bp, Artificial Sequence
  Mouse 17H6 heavy chain variable complementarity determining regions 3 (CDR3) sequence
gattactacggtagtaaccctgcctggtttgcttac

SEQ ID NO: 843 - DNA, 33 bp, Artificial Sequence
  Mouse 17H6 heavy chain variable framework 4 (FW4) sequence
tggggccaagggactctggtcactgtctctgca

SEQ ID NO: 844 - DNA, 393 bp, Artificial Sequence
  Mouse Antibody 17H6 Light chain: DNA sequence - Signal sequence FR1CDR1FR2CDR2FR3CDR3FR4
atgaagttgcctgtgaggctgttggtgctgatgttctggattcctgcttccaacagtgatattttgatgacccagactccactctccctgcctgtcagtcttggagatcaagcctccatctcttgcagatctagtcagagcattgtacatagtagtggaaacacctttttagaatggtacctgcagaaacctggccagtctccaaagctcctgatctacaaagtttccaaccgattttctggggtcccagacaggttcagtggcagtggatcagggatagatttcacactcaagatcagcagagtggaggctgaggatctgggagtttattactgctttcaaggttcacatgttcctttcacgttcggctcggggacaaagttggaaataaaa

SEQ ID NO: 845 - protein, 131 aa, Artificial Sequence
  Mouse Antibody 17H6 Light chain: Amino acid sequence - Signal peptideFR1CDR1FR2CDR2FR3CDR3FR4
MKLPVRLLVLMFWIPASNSDILMTQTPLSLPVSLGDQASISCRSSQSIVHSSGNTFLEWYLQKPGQSPKLLIYKVSNRFSGVPDRFSGSGSGIDFTLKISRVEAEDLGVYYCFQGSHVPFTFGSGTKLEIK

SEQ ID NO: 846 - DNA, 69 bp, Artificial Sequence
  Mouse 17H6 light chain variable framework 1 (FW1) sequence
gatattttgatgacccagactccactctccctgcctgtcagtcttggagatcaagcctccatctcttgc

SEQ ID NO: 847 - protein, 23 aa, Artificial Sequence
  Mouse 17H6 light chain variable framework 1 (FW1) sequence
DILMTQTPLSLPVSLGDQASISC

SEQ ID NO: 848 - DNA, 48 bp, Artificial Sequence
  Mouse 17H6 light chain variable complementarity determining regions 1 (CDR1) sequence
agatctagtcagagcattgtacatagtagtggaaacacctttttagaa

SEQ ID NO: 849 - protein, 16 aa, Artificial Sequence
  Mouse 17H6 light chain variable complementarity determining regions 1 (CDR1) sequence
RSSQSIVHSSGNTFLE

SEQ ID NO: 850 - DNA, 45 bp, Artificial Sequence
  Mouse 17H6 light chain variable framework 2 (FW2) sequence
tggtacctgcagaaacctggccagtctccaaagctcctgatctac

SEQ ID NO: 851 - protein, 15 aa, Artificial Sequence
  Mouse 17H6 light chain variable framework 2 (FW2) sequence
WYLQKPGQSPKLLIY

SEQ ID NO: 852 - DNA, 21 bp, Artificial Sequence
  Mouse 17H6 light chain variable complementarity determining regions 2 (CDR2) sequence
aaagtttccaaccgattttct

SEQ ID NO: 853 - protein, 7 aa, Artificial Sequence
  Mouse 17H6 light chain variable complementarity determining regions 2 (CDR2) sequence
KVSNRFS

SEQ ID NO: 854 - DNA, 96 bp, Artificial Sequence
  Mouse 17H6 light chain variable framework 3 (FW3) sequence
ggggtcccagacaggttcagtggcagtggatcagggatagatttcacactcaagatcagcagagtggaggctgaggatctgggagtttattactgc

SEQ ID NO: 855 - protein, 32 aa, Artificial Sequence
  Mouse 17H6 light chain variable framework 3 (FW3) sequence
GVPDRFSGSGSGIDFTLKISRVEAEDLGVYYC

SEQ ID NO: 856 - DNA, 27 bp, Artificial Sequence
  Mouse 17H6 light chain variable complementarity determining regions 3 (CDR3) sequence
tttcaaggttcacatgttcctttcacg

SEQ ID NO: 857 - protein, 9 aa, Artificial Sequence
  Mouse 17H6 light chain variable complementarity determining regions 3 (CDR3) sequence
FQGSHVPFT

SEQ ID NO: 858 - DNA, 30 bp, Artificial Sequence
  Mouse 17H6 light chain variable framework 4 (FW4) sequence
ttcggctcggggacaaagttggaaataaaa

SEQ ID NO: 859 - protein, 10 aa, Artificial Sequence
  Mouse 17H6 light chain variable framework 4 (FW4) sequence
FGSGTKLEIK

SEQ ID NO: 860 - DNA, 408 bp, Artificial Sequence
  Mouse antibody 39H5 Heavy chain: DNA sequence - Signal sequenceFR1CDR1FR2CDR2FR3CDR3FR4
atggcttgggtgtggaccttgctattcctgatggcagctgcccaaagtgcccaagcacagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccaacatatgttggtgacttcaagggacggtttgccttctctttggagacctctgccagcactgcctatttgcagatcaacaacctcaaaaatgaggacacggctacatatttttgtgttagaggtatccacggctacgtggactactggggccaaggcaccactctcacagtctcctca

SEQ ID NO: 861 - protein, 136 aa, Artificial Sequence
  Mouse antibody 39H5 Heavy chain: Amino acid sequence - Signal peptideFR1CDR1FR2CDR2FR3CDR3FR4
MAWVWTLLFLMAAAQSAQAQIQLVQSGPELKKPGETVKISCKASGYTFTNYGMNWVKQAPGKGLKWMGWINTYTGEPTYVGDFKGRFAFSLETSASTAYLQINNLKNEDTATYFCVRGIHGYVDYWGQGTTLTVSS

SEQ ID NO: 862 - DNA, 90 bp, Artificial Sequence
  Mouse antibody 39H5 heavy chain variable framework 1 (FW1) sequence
cagatccagttggtgcagtctggacctgagctgaagaagcctggagagacagtcaagatctcctgcaaggcttctgggtataccttcaca

SEQ ID NO: 863 - protein, 30 aa, Artificial Sequence
  Mouse antibody 39H5 heavy chain variable framework 1 (FW1) sequence
QIQLVQSGPELKKPGETVKISCKASGYTFT

SEQ ID NO: 864 - DNA, 15 bp, Artificial Sequence
  Mouse antibody 39H5 heavy chain variable complementarity determining regions 1 (CDR1) sequence
aactatggaatgaac

SEQ ID NO: 865 - protein, 5 aa, Artificial Sequence
  Mouse antibody 39H5 heavy chain variable complementarity determining regions 1 (CDR1) sequence
NYGMN

SEQ ID NO: 866 - DNA, 42 bp, Artificial Sequence
  Mouse antibody 39H5 heavy chain variable framework 2 (FW2) sequence
tgggtgaagcaggctccaggaaagggtttaaagtggatgggc

SEQ ID NO: 867 - protein, 14 aa, Artificial Sequence
  Mouse antibody 39H5 heavy chain variable framework 2 (FW2) sequence
WVKQAPGKGLKWMG

SEQ ID NO: 868 - DNA, 51 bp, Artificial Sequence
  Mouse antibody 39H5 heavy chain variable complementarity determining regions 2 (CDR2) sequence
tggataaacacctacactggagagccaacatatgttggtgacttcaaggga

SEQ ID NO: 869 - protein, 17 aa, Artificial Sequence
  Mouse antibody 39H5 heavy chain variable complementarity determining regions 2 (CDR2) sequence
WINTYTGEPTYVGDFKG

SEQ ID NO: 870 - DNA, 96 bp, Artificial Sequence
  Mouse antibody 39H5 heavy chain variable framework 3 (FW3) sequence
cggtttgccttctctttggagacctctgccagcactgcctatttgcagatcaacaacctcaaaaatgaggacacggctacatatttttgtgttaga

SEQ ID NO: 871 - protein, 32 aa, Artificial Sequence
  Mouse antibody 39H5 heavy chain variable framework 3 (FW3) sequence
RFAFSLETSASTAYLQINNLKNEDTATYFCVR

SEQ ID NO: 872 - DNA, 24 bp, Artificial Sequence
  Mouse antibody 39H5 heavy chain variable complementarity determining regions 3 (CDR3) sequence
ggtatccacggctacgtggactac

SEQ ID NO: 873 - protein, 8 aa, Artificial Sequence
  Mouse antibody 39H5 heavy chain variable complementarity determining regions 3 (CDR3) sequence
GIHGYVDY

SEQ ID NO: 874 - DNA, 33 bp, Artificial Sequence
  Mouse antibody 39H5 heavy chain variable framework 4 (FW4) sequence
tggggccaaggcaccactctcacagtctcctca

SEQ ID NO: 875 - protein, 11 aa, Artificial Sequence
  Mouse antibody 39H5 heavy chain variable framework 4 (FW4) sequence
WGQGTTLTVSS

SEQ ID NO: 876 - DNA, 393 bp, Artificial Sequence
  Mouse antibody 39H5 Light chain: DNA sequence - Signal sequenceFR1CDR1FR2CDR2FR3CDR3FR4
atgaagttgcctgttaggctgttggtgctgatgttctggattcctgcttccagcagtgatgttttgatgacccaaactccactctccctgcctgtcagtcttggagatcaagcctccatctcttgcagatctagtcagagcattgtacatagaaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatcttccgtggacgttcggtggaggcaccaagctggaaatcaaa

SEQ ID NO: 877 - protein, 131 aa, Artificial Sequence
  Mouse antibody 39H5 Light chain: Amino acid sequence - Signal peptideFR1CDR1FR2CDR2FR3CDR3FR4
MKLPVRLLVLMFWIPASSSDVLMTQTPLSLPVSLGDQASISCRSSQSIVHRNGNTYLEWYLQKPGQSPKLLIYKVSNRFSGVPDRFSGSGSGTDFTLKISRVEAEDLGVYYCFQGSHLPWTFGGGTKLEIK

SEQ ID NO: 878 - DNA, 69 bp, Artificial Sequence; identical to SEQ ID NO: 460
  Mouse antibody 39H5 light chain variable framework 1 (FW1) sequence

SEQ ID NO: 879 - protein, 23 aa, Artificial Sequence
  Mouse antibody 39H5 light chain variable framework 1 (FW1) sequence
DVLMTQTPLSLPVSLGDQASISC

SEQ ID NO: 880 - DNA, 48 bp, Artificial Sequence
  Mouse antibody 39H5 light chain variable complementarity determining regions 1 (CDR1) sequence
agatctagtcagagcattgtacatagaaatggaaacacctatttagaa

SEQ ID NO: 881 - protein, 16 aa, Artificial Sequence
  Mouse antibody 39H5 light chain variable complementarity determining regions 1 (CDR1) sequence
RSSQSIVHRNGNTYLE

SEQ ID NO: 882 - DNA, 45 bp, Artificial Sequence; identical to SEQ ID NO: 464
  Mouse antibody 39H5 light chain variable framework 2 (FW2) sequence

SEQ ID NO: 883 - protein, 15 aa, Artificial Sequence
  Mouse antibody 39H5 light chain variable framework 2 (FW2) sequence
WYLQKPGQSPKLLIY

SEQ ID NO: 884 - DNA, 21 bp, Artificial Sequence
  Mouse antibody 39H5 light chain variable complementarity determining regions 2 (CDR2) sequence
aaagtttccaaccgattttct

SEQ ID NO: 885 - protein, 7 aa, Artificial Sequence
  Mouse antibody 39H5 light chain variable complementarity determining regions 2 (CDR2) sequence
KVSNRFS

SEQ ID NO: 886 - DNA, 96 bp, Artificial Sequence
  Mouse antibody 39H5 light chain variable framework 3 (FW3) sequence
ggggtcccagacaggttcagtggcagtggatcagggacagatttcacactcaagatcagcagagtggaggctgaggatctgggagtttattactgc

SEQ ID NO: 887 - protein, 32 aa, Artificial Sequence
  Mouse antibody 39H5 light chain variable framework 3 (FW3) sequence
GVPDRFSGSGSGTDFTLKISRVEAEDLGVYYC

SEQ ID NO: 888 - DNA, 27 bp, Artificial Sequence
  Mouse antibody 39H5 light chain variable complementarity determining regions 3 (CDR3) sequence
tttcaaggttcacatcttccgtggacg

SEQ ID NO: 889 - protein, 9 aa, Artificial Sequence
  Mouse antibody 39H5 light chain variable complementarity determining regions 3 (CDR3) sequence
FQGSHLPWT

SEQ ID NO: 890 - DNA, 30 bp, Artificial Sequence
  Mouse antibody 39H5 light chain variable framework 4 (FW4) sequence
ttcggtggaggcaccaagctggaaatcaaa

SEQ ID NO: 891 - protein, 10 aa, Artificial Sequence
  Mouse antibody 39H5 light chain variable framework 4 (FW4) sequence
FGGGTKLEIK

SEQ ID NO: 892 - DNA, 411 bp, Artificial Sequence
  Antibody 3C5 Heavy chain: DNA sequence - Signal sequenceFR1CDR1FR2CDR2FR3CDR3FR4
atggcttgggtgtggaccttgctgttcctgatggcagctgcccaaagtgcccaagcacagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggaaagccaacatatgctgatgacttcaagggacggtttgccttctctttggagacctctgccagcactgcctatttgcagatcaacaacctcaaaaatgaggacacggctacatatttctgtgcaagagggggactagatggttactacggctactggggccaaggcaccactctcacagtctcctca

SEQ ID NO: 893 - protein, 137 aa, Artificial Sequence
  Antibody 3C5 Heavy chain: Amino acid sequence - Signal peptideFR1CDR1FR2CDR2FR3CDR3FR4
MAWVWTLLFLMAAAQSAQAQIQLVQSGPELKKPGETVKISCKASGYTFTNYGMNWVKQAPGKGLKWMGWINTYTGKPTYADDFKGRFAFSLETSASTAYLQINNLKNEDTATYFCARGGLDGYYGYWGQGTTLTVSS

SEQ ID NO: 894 - DNA, 90 bp, Artificial Sequence; identical to SEQ ID NO: 862
  Mouse antibody 3C5 heavy chain variable framework 1 (FW1) sequence

SEQ ID NO: 895 - protein, 30 aa, Artificial Sequence; identical to SEQ ID NO: 863
  Mouse antibody 3C5 heavy chain variable framework 1 (FW1) sequence

SEQ ID NO: 896 - DNA, 15 bp, Artificial Sequence
  Mouse antibody 3C5 heavy chain variable complementarity determining regions 1 (CDR1) sequence
aactatggaatgaac

SEQ ID NO: 897 - protein, 5 aa, Artificial Sequence
  Mouse antibody 3C5 heavy chain variable complementarity determining regions 1 (CDR1) sequence
NYGMN

SEQ ID NO: 898 - DNA, 42 bp, Artificial Sequence; identical to SEQ ID NO: 866
  Mouse antibody 3C5 heavy chain variable framework 2 (FW2) sequence

SEQ ID NO: 899 - protein, 14 aa, Artificial Sequence
  Mouse antibody 3C5 heavy chain variable framework 2 (FW2) sequence
WVKQAPGKGLKWMG

SEQ ID NO: 900 - DNA, 51 bp, Artificial Sequence
  Mouse antibody 3C5 heavy chain variable complementarity determining regions 2 (CDR2) sequence
tggataaacacctacactggaaagccaacatatgctgatgacttcaaggga

SEQ ID NO: 901 - protein, 17 aa, Artificial Sequence
  Mouse antibody 3C5 heavy chain variable complementarity determining regions 2 (CDR2) sequence
WINTYTGKPTYADDFKG

SEQ ID NO: 902 - DNA, 96 bp, Artificial Sequence
  Mouse antibody 3C5 heavy chain variable framework 3 (FW3) sequence
cggtttgccttctctttggagacctctgccagcactgcctatttgcagatcaacaacctcaaaaatgaggacacggctacatatttctgtgcaaga

SEQ ID NO: 903 - protein, 32 aa, Artificial Sequence
  Mouse antibody 3C5 heavy chain variable framework 3 (FW3) sequence
RFAFSLETSASTAYLQINNLKNEDTATYFCAR

SEQ ID NO: 904 - DNA, 27 bp, Artificial Sequence
  Mouse antibody 3C5 heavy chain variable complementarity determining regions 3 (CDR3) sequence
gggggactagatggttactacggctac

SEQ ID NO: 905 - protein, 9 aa, Artificial Sequence
  Mouse antibody 3C5 heavy chain variable complementarity determining regions 3 (CDR3) sequence
GGLDGYYGY

SEQ ID NO: 906 - DNA, 33 bp, Artificial Sequence; identical to SEQ ID NO: 874
  Mouse antibody 3C5 heavy chain variable framework 4 (FW4) sequence

SEQ ID NO: 907 - protein, 11 aa, Artificial Sequence
  Mouse antibody 3C5 heavy chain variable framework 4 (FW4) sequence
WGQGTTLTVSS

SEQ ID NO: 908 - DNA, 393 bp, Artificial Sequence
  Antibody 3C5 Light chain: DNA sequence (393 bp) - Signal sequenceFR1CDR1FR2CDR2FR3CDR3FR4
atgagtcctgcccagttcctgtttctgctagtgctctcgattcaggaaaccaacggtgatgttgtgatggctcagaccccactcactttgtcggttaccattggacaaccagcctccatctcttgcaaatcaagtcagagcctcttacatagtaaaggaaagacatatttgaattggttattacagaggccaggccagtctccaaagctcctaatctatctggtgtctaaactggaatctggagtccctgacaggttcagtggcagtggatcagggacagatttcacactgaaaatcagcagagtggaggctgaagatttgggagtttattactgcttgcaaactacacattttccgtggacgttcggtggaggcaccaagctggaaatcaaa

SEQ ID NO: 909 - protein, 131 aa, Artificial Sequence
  Antibody 3C5 Light chain: Amino acid sequence (131 aa) - Signal peptideFR1CDR1FR2CDR2FR3CDR3FR4
MSPAQFLFLLVLSIQETNGDVVMAQTPLTLSVTIGQPASISCKSSQSLLHSKGKTYLNWLLQRPGQSPKLLIYLVSKLESGVPDRFSGSGSGTDFTLKISRVEAEDLGVYYCLQTTHFPWTFGGGTKLEIK

SEQ ID NO: 910 - DNA, 69 bp, Artificial Sequence
  Mouse antibody 3C5 light chain variable framework 1 (FW1) sequence
gatgttgtgatggctcagaccccactcactttgtcggttaccattggacaaccagcctccatctcttgc

SEQ ID NO: 911 - protein, 23 aa, Artificial Sequence
  Mouse antibody 3C5 light chain variable framework 1 (FW1) sequence
DVVMAQTPLTLSVTIGQPASISC

SEQ ID NO: 912 - DNA, 48 bp, Artificial Sequence
  Mouse antibody 39H5 light chain variable complementarity determining regions 1 (CDR1) sequence
aaatcaagtcagagcctcttacatagtaaaggaaagacatatttgaat

SEQ ID NO: 913 - protein, 16 aa, Artificial Sequence
  Mouse antibody 39H5 light chain variable complementarity determining regions 1 (CDR1) sequence
KSSQSLLHSKGKTYLN

SEQ ID NO: 914 - DNA, 45 bp, Artificial Sequence
  Mouse antibody 3C5 light chain variable framework 2 (FW2) sequence
tggttattacagaggccaggccagtctccaaagctcctaatctat

SEQ ID NO: 915 - protein, 15 aa, Artificial Sequence
  Mouse antibody 3C5 light chain variable framework 2 (FW2) sequence
WLLQRPGQSPKLLIY

SEQ ID NO: 916 - DNA, 21 bp, Artificial Sequence
  Mouse antibody 3C5 light chain variable complementarity determining regions 2 (CDR2) sequence
ctggtgtctaaactggaatct

SEQ ID NO: 917 - protein, 7 aa, Artificial Sequence
  Mouse antibody 3C5 light chain variable complementarity determining regions 2 (CDR2) sequence
LVSKLES

SEQ ID NO: 918 - DNA, 96 bp, Artificial Sequence
  Mouse antibody 3C5 light chain variable framework 3 (FW3) sequence
ggagtccctgacaggttcagtggcagtggatcagggacagatttcacactgaaaatcagcagagtggaggctgaagatttgggagtttattactgc

SEQ ID NO: 919 - protein, 32 aa, Artificial Sequence; identical to SEQ ID NO: 887
  Mouse antibody 3C5 light chain variable framework 3 (FW3) sequence

SEQ ID NO: 920 - DNA, 27 bp, Artificial Sequence
  Mouse antibody 3C5 light chain variable complementarity determining regions 3 (CDR3) sequence
ttgcaaactacacattttccgtggacg

SEQ ID NO: 921 - protein, 9 aa, Artificial Sequence
  Mouse antibody 3C5 light chain variable complementarity determining regions 3 (CDR3) sequence
LQTTHFPWT

SEQ ID NO: 922 - DNA, 30 bp, Artificial Sequence; identical to SEQ ID NO: 890
  Mouse antibody 3C5 light chain variable framework 4 (FW4) sequence

SEQ ID NO: 923 - protein, 10 aa, Artificial Sequence
  Mouse antibody 3C5 light chain variable framework 4 (FW4) sequence
FGGGTKLEIK

SEQ ID NO: 924 - DNA, 420 bp, Artificial Sequence
  Mouse antibody 8A9 Heavy chain: DNA sequence (420 bp) - Signal sequenceFR1CDR1FR2CDR2FR3CDR3FR4
atgaagttgtggctgaactggattttccttgtaacacttttaaatggtatccagtgtgaggtggagctggtggagtctggaggaggcttggtacagcctgggggttctctgagactctcctgtgcaacttctgggttcaccttcactgatcactacatgagctgggtccgccagcctccaggaaaggcacttgagtggttgggatttattagaaacaaagctaatggttacacaacagagtacagtgcatctgtgaagggtcggttcaccatctccagagataattcccaaagcatcctctatcttcaaatgaaaaccctgagaactgaggacagtgccacttattactgtgcaagaccttctgactgggactcctggtttgcttactggggccaagggactctggtcactgtctctgca

SEQ ID NO: 925 - protein, 140 aa, Artificial Sequence
  Mouse antibody 8A9 Heavy chain: Amino acid sequence (140 aa) - Signal peptideFR1CDR1FR2CDR2FR3CDR3FR4
MKLWLNWIFLVTLLNGIQCEVELVESGGGLVQPGGSLRLSCATSGFTFTDHYMSWVRQPPGKALEWLGFIRNKANGYTTEYSASVKGRFTISRDNSQSILYLQMKTLRTEDSATYYCARPSDWDSWFAYWGQGTLVTVSA

SEQ ID NO: 926 - DNA, 90 bp, Artificial Sequence
  Mouse antibody 8A9 heavy chain variable framework 1 (FW1) sequence
gaggtggagctggtggagtctggaggaggcttggtacagcctgggggttctctgagactctcctgtgcaacttctgggttcaccttcact

SEQ ID NO: 927 - protein, 30 aa, Artificial Sequence
  Mouse antibody 8A9 heavy chain variable framework 1 (FW1) sequence
EVELVESGGGLVQPGGSLRLSCATSGFTFT

SEQ ID NO: 928 - DNA, 15 bp, Artificial Sequence
  Mouse antibody 8A9 heavy chain variable complementarity determining regions 1 (CDR1) sequence
gatcactacatgagc

SEQ ID NO: 929 - protein, 5 aa, Artificial Sequence
  Mouse antibody 8A9 heavy chain variable complementarity determining regions 1 (CDR1) sequence
DHYMS

SEQ ID NO: 930 - DNA, 42 bp, Artificial Sequence
  Mouse antibody 8A9 heavy chain variable framework 2 (FW2) sequence
tgggtccgccagcctccaggaaaggcacttgagtggttggga

SEQ ID NO: 931 - protein, 14 aa, Artificial Sequence
  Mouse antibody 8A9 heavy chain variable framework 2 (FW2) sequence
WVRQPPGKALEWLG

SEQ ID NO: 932 - DNA, 57 bp, Artificial Sequence
  Mouse antibody 8A9 heavy chain variable complementarity determining regions 2 (CDR2) sequence
tttattagaaacaaagctaatggttacacaacagagtacagtgcatctgtgaagggt

SEQ ID NO: 933 - protein, 19 aa, Artificial Sequence
  Mouse antibody 8A9 heavy chain variable complementarity determining regions 2 (CDR2) sequence
FIRNKANGYTTEYSASVKG

SEQ ID NO: 934 - DNA, 96 bp, Artificial Sequence
  Mouse antibody 8A9 heavy chain variable framework 3 (FW3) sequence
cggttcaccatctccagagataattcccaaagcatcctctatcttcaaatgaaaaccctgagaactgaggacagtgccacttattactgtgcaaga

SEQ ID NO: 935 - protein, 32 aa, Artificial Sequence
  Mouse antibody 8A9 heavy chain variable framework 3 (FW3) sequence
RFTISRDNSQSILYLQMKTLRTEDSATYYCAR

SEQ ID NO: 936 - DNA, 30 bp, Artificial Sequence
  Mouse antibody 8A9 heavy chain variable complementarity determining regions 3 (CDR3) sequence
ccttctgactgggactcctggtttgcttac

SEQ ID NO: 937 - protein, 10 aa, Artificial Sequence
  Mouse antibody 8A9 heavy chain variable complementarity determining regions 3 (CDR3) sequence
PSDWDSWFAY

SEQ ID NO: 938 - DNA, 33 bp, Artificial Sequence; identical to SEQ ID NO: 843
  Mouse antibody 8A9 heavy chain variable framework 4 (FW4) sequence

SEQ ID NO: 939 - protein, 11 aa, Artificial Sequence
  Mouse antibody 8A9 heavy chain variable framework 4 (FW4) sequence
WGQGTLVTVSA

SEQ ID NO: 940 - DNA, 393 bp, Artificial Sequence
  Mouse antibody 8A9 Light chain: DNA sequence (393 bp) - Signal sequenceFR1CDR1FR2CDR2FR3CDR3FR4
atgaagttgcctgttaggctgttggtgctgatgttctggattcctgcttccagcagtgatgttttgatgacccaaactccactctccctgcctgtcagtcttggtgatcaagcctccatctcttgcagatctagtcagagcattgtacatagtaatggcaacacctatttagattggtacttgcagaaaccaggccagtctccaaagctcctgatctacagagtttccaaccgattttctggggtcccagacaggttcagtggcagtggatcagggacagatttcacactcaagatcagcagagtggaggctgaggatctgggactttattactgttttcaaggttcacatgttccgtgggcgttcggtggaggcaccaagctggaaatcaaa

SEQ ID NO: 941 - protein, 131 aa, Artificial Sequence
  Mouse antibody 8A9 Light chain: Amino acid sequence (131 aa) - Signal peptideFR1CDR1FR2CDR2FR3CDR3FR4
MKLPVRLLVLMFWIPASSSDVLMTQTPLSLPVSLGDQASISCRSSQSIVHSNGNTYLDWYLQKPGQSPKLLIYRVSNRFSGVPDRFSGSGSGTDFTLKISRVEAEDLGLYYCFQGSHVPWAFGGGTKLEIK

SEQ ID NO: 942 - DNA, 69 bp, Artificial Sequence
  Mouse antibody 8A9 light chain variable framework 1 (FW1) sequence
gatgttttgatgacccaaactccactctccctgcctgtcagtcttggtgatcaagcctccatctcttgc

SEQ ID NO: 943 - protein, 23 aa, Artificial Sequence
  Mouse antibody 8A9 light chain variable framework 1 (FW1) sequence
DVLMTQTPLSLPVSLGDQASISC

SEQ ID NO: 944 - DNA, 48 bp, Artificial Sequence
  Mouse antibody 8A9 light chain variable complementarity determining regions 1 (CDR1) sequence
agatctagtcagagcattgtacatagtaatggcaacacctatttagat

SEQ ID NO: 945 - protein, 16 aa, Artificial Sequence
  Mouse antibody 8A9 light chain variable complementarity determining regions 1 (CDR1) sequence
RSSQSIVHSNGNTYLD

SEQ ID NO: 946 - DNA, 45 bp, Artificial Sequence
  Mouse antibody 8A9 light chain variable framework 2 (FW2) sequence
tggtacttgcagaaaccaggccagtctccaaagctcctgatctac

SEQ ID NO: 947 - protein, 15 aa, Artificial Sequence
  Mouse antibody 8A9 light chain variable framework 2 (FW2) sequence
WYLQKPGQSPKLLIY

SEQ ID NO: 948 - DNA, 21 bp, Artificial Sequence
  Mouse antibody 8A9 light chain variable complementarity determining regions 2 (CDR2) sequence
agagtttccaaccgattttct

SEQ ID NO: 949 - protein, 7 aa, Artificial Sequence
  Mouse antibody 8A9 light chain variable complementarity determining regions 2 (CDR2) sequence
RVSNRFS

SEQ ID NO: 950 - DNA, 96 bp, Artificial Sequence
  Mouse antibody 8A9 light chain variable framework 3 (FW3) sequence
ggggtcccagacaggttcagtggcagtggatcagggacagatttcacactcaagatcagcagagtggaggctgaggatctgggactttattactgt

SEQ ID NO: 951 - protein, 32 aa, Artificial Sequence
  Mouse antibody 8A9 light chain variable framework 3 (FW3) sequence
GVPDRFSGSGSGTDFTLKISRVEAEDLGLYYC

SEQ ID NO: 952 - DNA, 27 bp, Artificial Sequence
  Mouse antibody 8A9 light chain variable complementarity determining regions 3 (CDR3) sequence
tttcaaggttcacatgttccgtgggcg

SEQ ID NO: 953 - protein, 9 aa, Artificial Sequence
  Mouse antibody 8A9 light chain variable complementarity determining regions 3 (CDR3) sequence
FQGSHVPWA

SEQ ID NO: 954 - DNA, 30 bp, Artificial Sequence; identical to SEQ ID NO: 890
  Mouse antibody 8A9 light chain variable framework 4 (FW4) sequence

SEQ ID NO: 955 - protein, 10 aa, Artificial Sequence
  Mouse antibody 8A9 light chain variable framework 4 (FW4) sequence
FGGGTKLEIK

SEQ ID NO: 956 - DNA, 399 bp, Artificial Sequence
  Mouse antibody 18G12 Heavy chain: DNA sequence (399 bp) - Signal sequenceFR1CDR1FR2CDR2FR3CDR3FR4
atgggatggagctatatcatcctctttttggtcgcaacagctacaggtgtccactcccaggtccaactgcagcagtctggggctgaactggtgaagcctggggcttcagtgaagttgtcctgcaaggcttctggctacaccttcaccggctactttttgtactgggtgaagcagaggcctggacaaggccttgagtggattggggggattaatcctgacaatggtggtattgacttcaatgagaagttcaggaacaaggccacactgactgtagacaaatcctccagcacagcctacatgcaactcagcagcctgacatctgaggactctgcggtctattattgtacattactaatagggaactattggggccaaggcaccactctcacagtctcctca

SEQ ID NO: 957 - protein, 133 aa, Artificial Sequence
  Mouse antibody 18G12 Heavy chain: Amino acid sequence (133 aa) - Signal peptideFR1CDR1FR2CDR2FR3CDR3FR4
MGWSYIILFLVATATGVHSQVQLQQSGAELVKPGASVKLSCKASGYTFTGYFLYWVKQRPGQGLEWIGGINPDNGGIDFNEKFRNKATLTVDKSSSTAYMQLSSLTSEDSAVYYCTLLIGNYWGQGTTLTVSS

SEQ ID NO: 958 - DNA, 90 bp, Artificial Sequence
  Mouse antibody 18G12 heavy chain variable framework 1 (FW1) sequence
caggtccaactgcagcagtctggggctgaactggtgaagcctggggcttcagtgaagttgtcctgcaaggcttctggctacaccttcacc

SEQ ID NO: 959 - protein, 30 aa, Artificial Sequence
  Mouse antibody 18G12 heavy chain variable framework 1 (FW1) sequence
QVQLQQSGAELVKPGASVKLSCKASGYTFT

SEQ ID NO: 960 - DNA, 15 bp, Artificial Sequence
  Mouse antibody 39H5 heavy chain variable complementarity determining regions 1 (CDR1) sequence
ggctactttttgtac

SEQ ID NO: 961 - protein, 5 aa, Artificial Sequence
  Mouse antibody 39H5 heavy chain variable complementarity determining regions 1 (CDR1) sequence
GYFLY

SEQ ID NO: 962 - DNA, 42 bp, Artificial Sequence
  Mouse antibody 18G12 heavy chain variable framework 2 (FW2) sequence
tgggtgaagcagaggcctggacaaggccttgagtggattggg

SEQ ID NO: 963 - protein, 14 aa, Artificial Sequence
  Mouse antibody 18G12 heavy chain variable framework 2 (FW2) sequence
WVKQRPGQGLEWIG

SEQ ID NO: 964 - DNA, 51 bp, Artificial Sequence
  Mouse antibody 18G12 heavy chain variable complementarity determining regions 2 (CDR2) sequence
gggattaatcctgacaatggtggtattgacttcaatgagaagttcaggaac

SEQ ID NO: 965 - protein, 17 aa, Artificial Sequence
  Mouse antibody 18G12 heavy chain variable complementarity determining regions 2 (CDR2) sequence
GINPDNGGIDFNEKFRN

SEQ ID NO: 966 - DNA, 96 bp, Artificial Sequence
  Mouse antibody 18G12 heavy chain variable framework 3 (FW3) sequence
aaggccacactgactgtagacaaatcctccagcacagcctacatgcaactcagcagcctgacatctgaggactctgcggtctattattgtacatta

SEQ ID NO: 967 - protein, 32 aa, Artificial Sequence
  Mouse antibody 18G12 heavy chain variable framework 3 (FW3) sequence
KATLTVDKSSSTAYMQLSSLTSEDSAVYYCTL

SEQ ID NO: 968 - DNA, 15 bp, Artificial Sequence
  Mouse antibody 18G12 heavy chain variable complementarity determining regions 3 (CDR3) sequence
ctaatagggaactat

SEQ ID NO: 969 - protein, 5 aa, Artificial Sequence
  Mouse antibody 18G12 heavy chain variable complementarity determining regions 3 (CDR3) sequence
LIGNY

SEQ ID NO: 970 - DNA, 33 bp, Artificial Sequence; identical to SEQ ID NO: 874
  Mouse antibody 18G12 heavy chain variable framework 4 (FW4) sequence

SEQ ID NO: 971 - protein, 11 aa, Artificial Sequence
  Mouse antibody 18G12 heavy chain variable framework 4 (FW4) sequence
WGQGTTLTVSS

SEQ ID NO: 972 - DNA, 393 bp, Artificial Sequence
  Mouse antibody 18G12 Light chain: DNA sequence (393 bp) - Signal sequenceFR1CDR1FR2CDR2FR3CDR3FR4
atgagtcctgcccagttcctgtttctgttagtgctctggattcgggaaaccaatggtgatgttgtgatgacccagactccactcactttgtcggtaaccattggacagccagcctccatctcttgcaagtcaagtcagagcctcttacatagtgatggaaagacatatttgatttggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttatttttgctgtcaaggtacacattttccgtggacgttcggtggaggcaccatgctggaaatcaaa

SEQ ID NO: 973 - protein, 131 aa, Artificial Sequence
  Mouse antibody 18G12 Light chain: Amino acid sequence (131 aa) - Signal peptideFR1CDR1FR2CDR2FR3CDR3FR4
MSPAQFLFLLVLWIRETNGDVVMTQTPLTLSVTIGQPASISCKSSQSLLHSDGKTYLIWLLQRPGQSPKRLIYLVSKLDSGVPDRFTGSGSGTDFTLKISRVEAEDLGVYFCCQGTHFPWTFGGGTMLEIK

SEQ ID NO: 974 - DNA, 69 bp, Artificial Sequence
  Mouse antibody 18G12 light chain variable framework 1 (FW1) sequence
gatgttgtgatgacccagactccactcactttgtcggtaaccattggacagccagcctccatctcttgc

SEQ ID NO: 975 - protein, 23 aa, Artificial Sequence
  Mouse antibody 18G12 light chain variable framework 1 (FW1) sequence
DVVMTQTPLTLSVTIGQPASISC

SEQ ID NO: 976 - DNA, 48 bp, Artificial Sequence
  Mouse antibody 18G12 light chain variable complementarity determining regions 1 (CDR1) sequence
aagtcaagtcagagcctcttacatagtgatggaaagacatatttgatt

SEQ ID NO: 977 - protein, 16 aa, Artificial Sequence
  Mouse antibody 18G12 light chain variable complementarity determining regions 1 (CDR1) sequence
KSSQSLLHSDGKTYLI

SEQ ID NO: 978 - DNA, 45 bp, Artificial Sequence
  Mouse antibody 18G12 light chain variable framework 2 (FW2) sequence
tggttgttacagaggccaggccagtctccaaagcgcctaatctat

SEQ ID NO: 979 - protein, 15 aa, Artificial Sequence
  Mouse antibody 18G12 light chain variable framework 2 (FW2) sequence
WLLQRPGQSPKRLIY

SEQ ID NO: 980 - DNA, 21 bp, Artificial Sequence
  Mouse antibody 18G12 light chain variable complementarity determining regions 2 (CDR2) sequence
ctggtgtctaaactggactct

SEQ ID NO: 981 - protein, 7 aa, Artificial Sequence
  Mouse antibody 18G12 light chain variable complementarity determining regions 2 (CDR2) sequence
LVSKLDS

SEQ ID NO: 982 - DNA, 96 bp, Artificial Sequence
  Mouse antibody 18G12 light chain variable framework 3 (FW3) sequence
ggagtccctgacaggttcactggcagtggatcagggacagatttcacactgaaaatcagcagagtggaggctgaggatttgggagtttatttttgc

SEQ ID NO: 983 - protein, 32 aa, Artificial Sequence
  Mouse antibody 18G12 light chain variable framework 3 (FW3) sequence
GVPDRFTGSGSGTDFTLKISRVEAEDLGVYFC

SEQ ID NO: 984 - DNA, 27 bp, Artificial Sequence
  Mouse antibody 18G12 light chain variable complementarity determining regions 3 (CDR3) sequence
tgtcaaggtacacattttccgtggacg

SEQ ID NO: 985 - protein, 9 aa, Artificial Sequence
  Mouse antibody 18G12 light chain variable complementarity determining regions 3 (CDR3) sequence
CQGTHFPWT

SEQ ID NO: 986 - DNA, 30 bp, Artificial Sequence
  Mouse antibody 18G12 light chain variable framework 4 (FW4) sequence
ttcggtggaggcaccatgctggaaatcaaa

SEQ ID NO: 987 - protein, 10 aa, Artificial Sequence
  Mouse antibody 18G12 light chain variable framework 4 (FW4) sequence
FGGGTMLEIK

SEQ ID NO: 988 - DNA, 416 bp, Artificial Sequence
  Mouse antibody 20A10 Heavy chain: DNA sequence (417 bp) - Signal sequenceFR1CDR1FR2CDR2FR3CDR3FR4
atgaacttcgggttcagcttgattttccttgtccttgttttaaaaggtgtccagtgtgaagtgatgctggtggagtctgggggaggcttagtgaagcctggagggtccctgaaactctcctgtcagcctctggattcactttcagtacctatgccatgtcttggattcgccagactccagagaagaggctggagtgggtcgcatccattggtcgtgctggttccacctactattcagacagtgtgaagggccgattcaccatctccagagataatgtccggaacatcctgtacctgcaaatgagcagtctgaggtctgaggacacggccatgtattactgtgctagaggcccgatctacaatgattacgacgagtttgcttactggggccaagggactctggtcactgtctctgca

SEQ ID NO: 989 - protein, 139 aa, Artificial Sequence
  Mouse antibody 20A10 Heavy chain: Amino acid sequence (139 aa) - Signal peptideFR1CDR1FR2CDR2FR3CDR3FR4
MNFGFSLIFLVLVLKGVQCEVMLVESGGGLVKPGGSLKLSCAASGFTFSTYAMSWIRQTPEKRLEWVASIGRAGSTYYSDSVKGRFTISRDNVRNILYLQMSSLRSEDTAMYYCARGPIYNDYDEFAYWGQGTLVTVSA

SEQ ID NO: 990 - DNA, 90 bp, Artificial Sequence
  Mouse antibody 20A10 heavy chain variable framework 1 (FW1) sequence
gaagtgatgctggtggagtctgggggaggcttagtgaagcctggagggtccctgaaactctcctgtgcagcctctggattcactttcagt

SEQ ID NO: 991 - protein, 30 aa, Artificial Sequence
  Mouse antibody 20A10 heavy chain variable framework 1 (FW1) sequence
EVMLVESGGGLVKPGGSLKLSCAASGFTFS

SEQ ID NO: 992 - DNA, 15 bp, Artificial Sequence
  Mouse antibody 20A10 heavy chain variable complementarity determining regions 1 (CDR1) sequence
acctatgccatgtct

SEQ ID NO: 993 - protein, 5 aa, Artificial Sequence
  Mouse antibody 20A10 heavy chain variable complementarity determining regions 1 (CDR1) sequence
TYAMS

SEQ ID NO: 994 - DNA, 42 bp, Artificial Sequence
  Mouse antibody 20A10 heavy chain variable framework 2 (FW2) sequence
tggattcgccagactccagagaagaggctggagtgggtcgca

SEQ ID NO: 995 - protein, 14 aa, Artificial Sequence
  Mouse antibody 20A10 heavy chain variable framework 2 (FW2) sequence
WIRQTPEKRLEWVA

SEQ ID NO: 996 - DNA, 48 bp, Artificial Sequence
  Mouse antibody 20A10 heavy chain variable complementarity determining regions 2 (CDR2) sequence
tccattggtcgtgctggttccacctactattcagacagtgtgaagggc

SEQ ID NO: 997 - protein, 16 aa, Artificial Sequence
  Mouse antibody 20A10 heavy chain variable complementarity determining regions 2 (CDR2) sequence
SIGRAGSTYYSDSVKG

SEQ ID NO: 998 - DNA, 96 bp, Artificial Sequence
  Mouse antibody 20A10 heavy chain variable framework 3 (FW3) sequence
cgattcaccatctccagagataatgtccggaacatcctgtacctgcaaatgagcagtctgaggtctgaggacacggccatgtattactgtgctaga

SEQ ID NO: 999 - protein, 32 aa, Artificial Sequence
  Mouse antibody 20A10 heavy chain variable framework 3 (FW3) sequence
RFTISRDNVRNILYLQMSSLRSEDTAMYYCAR

SEQ ID NO: 1000 - DNA, 36 bp, Artificial Sequence
  Mouse antibody 20A10 heavy chain variable complementarity determining regions 3 (CDR3) sequence
ggcccgatctacaatgattacgacgagtttgcttac

SEQ ID NO: 1001 - protein, 12 aa, Artificial Sequence
  Mouse antibody 20A10 heavy chain variable complementarity determining regions 3 (CDR3) sequence
GPIYNDYDEFAY

SEQ ID NO: 1002 - DNA, 33 bp, Artificial Sequence; identical to SEQ ID NO: 843
  Mouse antibody 20A10 heavy chain variable framework 4 (FW4) sequence

SEQ ID NO: 1003 - protein, 11 aa, Artificial Sequence
  Mouse antibody 20A10 heavy chain variable framework 4 (FW4) sequence
WGQGTLVTVSA

SEQ ID NO: 1004 - DNA, 396 bp, Artificial Sequence
  Mouse antibody 20A10 Light chain: DNA sequence (396 bp) - Signal sequenceFR1CDR1FR2CDR2FR3CDR3FR4
atggaatcacagactcaggtcttcctctccctgctgctctgggtatctggtacctgtgggaacattatgatgacacagtcgccatcatctctggctgtgtctgcaggagaaaaggtcactatgagctgtaagtccagtcaaagtgttttatacagttcaaatcagaagaactatttggcctggtaccagcagaaaccagggcagtctcctaaactgctgatctactgggcatccactagggaatctggtgtccctgatcgcttcacaggcagtggatctgggacagattttactcttaccatcagcagtgtacaagctgaagacctggcagtttattactgtcatcaatacctctcctcgctcacgttcggtgctgggaccaagctggagctgaaa

SEQ ID NO: 1005 - protein, 132 aa, Artificial Sequence
  Mouse antibody 20A10 Light chain: Amino acid sequence (132 aa) - Signal peptideFR1CDR1FR2CDR2FR3CDR3FR4
MESQTQVFLSLLLWVSGTCGNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELK

SEQ ID NO: 1006 - DNA, 69 bp, Artificial Sequence
  Mouse antibody 20A10 light chain variable framework 1 (FW1) sequence
aacattatgatgacacagtcgccatcatctctggctgtgtctgcaggagaaaaggtcactatgagctgt

SEQ ID NO: 1007 - protein, 23 aa, Artificial Sequence
  Mouse antibody 20A10 light chain variable framework 1 (FW1) sequence
NIMMTQSPSSLAVSAGEKVTMSC

SEQ ID NO: 1008 - DNA, 51 bp, Artificial Sequence
  Mouse antibody 20A10 light chain variable complementarity determining regions 1 (CDR1) sequence
aagtccagtcaaagtgttttatacagttcaaatcagaagaactatttggcc

SEQ ID NO: 1009 - protein, 17 aa, Artificial Sequence
  Mouse antibody 20A10 light chain variable complementarity determining regions 1 (CDR1) sequence
KSSQSVLYSSNQKNYLA

SEQ ID NO: 1010 - DNA, 45 bp, Artificial Sequence
  Mouse antibody 20A10 light chain variable framework 2 (FW2) sequence
tggtaccagcagaaaccagggcagtctcctaaactgctgatctac

SEQ ID NO: 1011 - protein, 15 aa, Artificial Sequence
  Mouse antibody 20A10 light chain variable framework 2 (FW2) sequence
WYQQKPGQSPKLLIY

SEQ ID NO: 1012 - DNA, 21 bp, Artificial Sequence
  Mouse antibody 20A10 light chain variable complementarity determining regions 2 (CDR2) sequence
tgggcatccactagggaatct

SEQ ID NO: 1013 - protein, 7 aa, Artificial Sequence
  Mouse antibody 20A10 light chain variable complementarity determining regions 2 (CDR2) sequence
WASTRES

SEQ ID NO: 1014 - DNA, 96 bp, Artificial Sequence
  Mouse antibody 20A10 light chain variable framework 3 (FW3) sequence
ggtgtccctgatcgcttcacaggcagtggatctgggacagattttactcttaccatcagcagtgtacaagctgaagacctggcagtttattactgt

SEQ ID NO: 1015 - protein, 32 aa, Artificial Sequence
  Mouse antibody 20A10 light chain variable framework 3 (FW3) sequence
GVPDRFTGSGSGTDFTLTISSVQAEDLAVYYC

SEQ ID NO: 1016 - DNA, 24 bp, Artificial Sequence
  Mouse antibody 20A10 light chain variable complementarity determining regions 3 (CDR3) sequence
catcaatacctctcctcgctcacg

SEQ ID NO: 1017 - protein, 8 aa, Artificial Sequence
  Mouse antibody 20A10 light chain variable complementarity determining regions 3 (CDR3) sequence
HQYLSSLT

SEQ ID NO: 1018 - DNA, 30 bp, Artificial Sequence
  Mouse antibody 20A10 light chain variable framework 4 (FW4) sequence
ttcggtgctgggaccaagctggagctgaaa

SEQ ID NO: 1019 - protein, 10 aa, Artificial Sequence
  Mouse antibody 20A10 light chain variable framework 4 (FW4) sequence
FGAGTKLELK

SEQ ID NO: 1020 - DNA, 413 bp, Artificial Sequence
  Mouse antibody 25E6 Heavy chain: DNA sequence (414 bp) - Signal sequenceFR1CDR1FR2CDR2FR3CDR3FR4
atgaacttcgggctcagcttgattttccttgccctcattttaaaaggtgtccagtgtgaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagttgaggacacagccatgtatttatgtgtaagacagactgggacggagggctggtttgcttactggggccaagggactctggtcactgtctctgca

SEQ ID NO: 1021 - protein, 138 aa, Artificial Sequence
  Mouse antibody 25E6 Heavy chain: Amino acid sequence (138 aa) - Signal peptideFR1CDR1FR2CDR2FR3CDR3FR4
MNFGLSLIFLALILKGVQCEVQLVESGGDLVKPGGSLKLSCAASGFTFSSYGMSWVRQTPDKRLEWVATISNGGRHTFYPDSVKGRFTISRDNAKNTLYLQMSSLKSEDTAMYLCVRQTGTEGWFAYWGQGTLVTVSA

SEQ ID NO: 1022 - DNA, 90 bp, Artificial Sequence
  Mouse antibody 25E6 heavy chain variable framework 1 (FW1) sequence
gaggtgcagctggtggagtctgggggagacttagtgaagcctggagggtccctgaaactctcctgtgcagcctctggtttcactttcagt

SEQ ID NO: 1023 - protein, 30 aa, Artificial Sequence
  Mouse antibody 25E6 heavy chain variable framework 1 (FW1) sequence
EVQLVESGGDLVKPGGSLKLSCAASGFTFS

SEQ ID NO: 1024 - DNA, 15 bp, Artificial Sequence
  Mouse antibody 25E6 heavy chain variable complementarity determining regions 1 (CDR1) sequence
agttatggaatgtct

SEQ ID NO: 1025 - protein, 5 aa, Artificial Sequence
  Mouse antibody 25E6 heavy chain variable complementarity determining regions 1 (CDR1) sequence
SYGMS

SEQ ID NO: 1026 - DNA, 42 bp, Artificial Sequence
  Mouse antibody 25E6 heavy chain variable framework 2 (FW2) sequence
tgggttcgccagactccagacaagaggctggagtgggtcgca

SEQ ID NO: 1027 - protein, 14 aa, Artificial Sequence
  Mouse antibody 25E6 heavy chain variable framework 2 (FW2) sequence
WVRQTPDKRLEWVA

SEQ ID NO: 1028 - DNA, 51 bp, Artificial Sequence
  Mouse antibody 25E6 heavy chain variable complementarity determining regions 2 (CDR2) sequence
accattagtaatggtggtagacacaccttctatccagacagtgtgaagggg

SEQ ID NO: 1029 - protein, 17 aa, Artificial Sequence
  Mouse antibody 25E6 heavy chain variable complementarity determining regions 2 (CDR2) sequence
TISNGGRHTFYPDSVKG

SEQ ID NO: 1030 - DNA, 96 bp, Artificial Sequence
  Mouse antibody 25E6 heavy chain variable framework 3 (FW3) sequence
cgattcaccatctccagagacaatgccaagaacaccctgtatctgcaaatgagcagtctgaagtctgaggacacagccatgtatttatgtgtaaga

SEQ ID NO: 1031 - protein, 32 aa, Artificial Sequence
  Mouse antibody 25E6 heavy chain variable framework 3 (FW3) sequence
RFTISRDNAKNTLYLQMSSLKSEDTAMYLCVR

SEQ ID NO: 1032 - DNA, 30 bp, Artificial Sequence
  Mouse antibody 25E6 heavy chain variable complementarity determining regions 3 (CDR3) sequence
cagactgggacggagggctggtttgcttac

SEQ ID NO: 1033 - protein, 10 aa, Artificial Sequence
  Mouse antibody 25E6 heavy chain variable complementarity determining regions 3 (CDR3) sequence
QTGTEGWFAY

SEQ ID NO: 1034 - DNA, 33 bp, Artificial Sequence; identical to SEQ ID NO: 843
  Mouse antibody 25E6 heavy chain variable framework 4 (FW4) sequence

SEQ ID NO: 1035 - protein, 11 aa, Artificial Sequence
  Mouse antibody 25E6 heavy chain variable framework 4 (FW4) sequence
WGQGTLVTVSA

SEQ ID NO: 1036 - DNA, 392 bp, Artificial Sequence
  Mouse antibody 25E6 Light chain: DNA sequence (393 bp) - Signal sequenceFR1CDR1FR2CDR2FR3CDR3FR4
atgagtcctgcccagttcctgtttctgttagtgctctggattcgggaaaccaacggtgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagggaggctgaggatttgggagtttattattgctggcaaggtacacattttcctcagacgttcggtggaggcaccaagctggaaatcaaa

SEQ ID NO: 1037 - protein, 131 aa, Artificial Sequence
  Mouse antibody 25E6 Light chain: Amino acid sequence (131 aa) - Signal peptideFR1CDR1FR2CDR2FR3CDR3FR4
MSPAQFLFLLVLWIRETNGDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIK

SEQ ID NO: 1038 - DNA, 69 bp, Artificial Sequence
  Mouse antibody 25E6 light chain variable framework 1 (FW1) sequence
gatgttgtgatgacccagactccactcactttgtcggttaccattggacaaccagcctccatctcttgc

SEQ ID NO: 1039 - protein, 23 aa, Artificial Sequence
  Mouse antibody 25E6 light chain variable framework 1 (FW1) sequence
DVVMTQTPLTLSVTIGQPASISC

SEQ ID NO: 1040 - DNA, 48 bp, Artificial Sequence
  Mouse antibody 25E6 light chain variable complementarity determining regions 1 (CDR1) sequence
aagtcaagtcagagcctcttagatagtgatggaaagacatatttgaat

SEQ ID NO: 1041 - protein, 16 aa, Artificial Sequence
  Mouse antibody 25E6 light chain variable complementarity determining regions 1 (CDR1) sequence
KSSQSLLDSDGKTYLN

SEQ ID NO: 1042 - DNA, 45 bp, Artificial Sequence; identical to SEQ ID NO: 978
  Mouse antibody 25E6 light chain variable framework 2 (FW2) sequence

SEQ ID NO: 1043 - protein, 15 aa, Artificial Sequence
  Mouse antibody 25E6 light chain variable framework 2 (FW2) sequence
WLLQRPGQSPKRLIY

SEQ ID NO: 1044 - DNA, 21 bp, Artificial Sequence
  Mouse antibody 25E6 light chain variable complementarity determining regions 2 (CDR2) sequence
ctggtgtctaaactggactct

SEQ ID NO: 1045 - protein, 7 aa, Artificial Sequence
  Mouse antibody 25E6 light chain variable complementarity determining regions 2 (CDR2) sequence
LVSKLDS

SEQ ID NO: 1046 - DNA, 96 bp, Artificial Sequence
  Mouse antibody 25E6 light chain variable framework 3 (FW3) sequence
ggagtccctgacaggttcactggcagtggatcagggacagatttcacactgaaaatcagcagagtggaggctgaggatttgggagtttattattgc

SEQ ID NO: 1047 - protein, 32 aa, Artificial Sequence
  Mouse antibody 25E6 light chain variable framework 3 (FW3) sequence
GVPDRFTGSGSGTDFTLKISRVEAEDLGVYYC

SEQ ID NO: 1048 - DNA, 27 bp, Artificial Sequence
  Mouse antibody 25E6 light chain variable complementarity determining regions 3 (CDR3) sequence
tggcaaggtacacattttcctcagacg

SEQ ID NO: 1049 - protein, 9 aa, Artificial Sequence
  Mouse antibody 25E6 light chain variable complementarity determining regions 3 (CDR3) sequence
WQGTHFPQT

SEQ ID NO: 1050 - DNA, 30 bp, Artificial Sequence; identical to SEQ ID NO: 890
  Mouse antibody 25E6 light chain variable framework 4 (FW4) sequence

SEQ ID NO: 1051 - protein, 10 aa, Artificial Sequence
  Mouse antibody 25E6 light chain variable framework 4 (FW4) sequence
FGGGTKLEIK

SEQ ID NO: 1052 - DNA, 399 bp, Artificial Sequence
  Mouse antibody 28F9 Heavy chain: DNA sequence (399 bp) - Signal sequenceFR1CDR1FR2CDR2FR3CDR3FR4
atgggatggagctatatcatcctctttttggtagcaacagctacaggtgtccactcccaggtccaactgcagcagcctggggctgaactggtgcagcctggggcttcagtgaagttgtcctgcaaggcttctggctacaccttcaccggctactttttgtactgggtgaagcagaggcctggacatggccttgagtggattgggggaattcatcctagcaatggtgatactgacttcaatgagaagttcaagaacaaggccacactgactgtagacatatcctccagcactgcctacatgcaactcagcagcctgacatctgaggactctgcggtctattattgtacattactaataggggtctactggggccaaggcaccactctcacagtctcctca

SEQ ID NO: 1053 - protein, 133 aa, Artificial Sequence
  Mouse antibody 28F9 Heavy chain: Amino acid sequence (133 aa) - Signal peptideFR1CDR1FR2CDR2FR3CDR3FR4
MGWSYIILFLVATATGVHSQVQLQQPGAELVQPGASVKLSCKASGYTFTGYFLYWVKQRPGHGLEWIGGIHPSNGDTDFNEKFKNKATLTVDISSSTAYMQLSSLTSEDSAVYYCTLLIGVYWGQGTTLTVSS

SEQ ID NO: 1054 - DNA, 90 bp, Artificial Sequence
  Mouse antibody 28F9 heavy chain variable framework 1 (FW1) sequence
caggtccaactgcagcagcctggggctgaactggtgcagcctggggcttcagtgaagttgtcctgcaaggcttctggctacaccttcacc

SEQ ID NO: 1055 - protein, 30 aa, Artificial Sequence
  Mouse antibody 28F9 heavy chain variable framework 1 (FW1) sequence
QVQLQQPGAELVQPGASVKLSCKASGYTFT

SEQ ID NO: 1056 - DNA, 15 bp, Artificial Sequence
  Mouse antibody 28F9 heavy chain variable complementarity determining regions 1 (CDR1) sequence
ggctactttttgtac

SEQ ID NO: 1057 - protein, 5 aa, Artificial Sequence
  Mouse antibody 28F9 heavy chain variable complementarity determining regions 1 (CDR1) sequence
GYFLY

SEQ ID NO: 1058 - DNA, 42 bp, Artificial Sequence
  Mouse antibody 28F9 heavy chain variable framework 2 (FW2) sequence
tgggtgaagcagaggcctggacatggccttgagtggattggg

SEQ ID NO: 1059 - protein, 14 aa, Artificial Sequence
  Mouse antibody 28F9 heavy chain variable framework 2 (FW2) sequence
WVKQRPGHGLEWIG

SEQ ID NO: 1060 - DNA, 51 bp, Artificial Sequence
  Mouse antibody 28F9 heavy chain variable complementarity determining regions 2 (CDR2) sequence
ggaattcatcctagcaatggtgatactgacttcaatgagaagttcaagaac

SEQ ID NO: 1061 - protein, 17 aa, Artificial Sequence
  Mouse antibody 28F9 heavy chain variable complementarity determining regions 2 (CDR2) sequence
GIHPSNGDTDFNEKFKN

SEQ ID NO: 1062 - DNA, 96 bp, Artificial Sequence
  Mouse antibody 28F9 heavy chain variable framework 3 (FW3) sequence
aaggccacactgactgtagacatatcctccagcactgcctacatgcaactcagcagcctgacatctgaggactctgcggtctattattgtacatta

SEQ ID NO: 1063 - protein, 32 aa, Artificial Sequence
  Mouse antibody 28F9 heavy chain variable framework 3 (FW3) sequence
KATLTVDISSSTAYMQLSSLTSEDSAVYYCTL

SEQ ID NO: 1064 - DNA, 15 bp, Artificial Sequence
  Mouse antibody 28F9 heavy chain variable complementarity determining regions 3 (CDR3) sequence
ctaataggggtctac

SEQ ID NO: 1065 - protein, 5 aa, Artificial Sequence
  Mouse antibody 28F9 heavy chain variable complementarity determining regions 3 (CDR3) sequence
LIGVY

SEQ ID NO: 1066 - DNA, 33 bp, Artificial Sequence; identical to SEQ ID NO: 874
  Mouse antibody 28F9 heavy chain variable framework 4 (FW4) sequence

SEQ ID NO: 1067 - protein, 11 aa, Artificial Sequence
  Mouse antibody 28F9 heavy chain variable framework 4 (FW4) sequence
WGQGTTLTVSS

SEQ ID NO: 1068 - DNA, 393 bp, Artificial Sequence
  Mouse antibody 28F9 Light chain: DNA sequence (393 bp) - Signal sequenceFR1CDR1FR2CDR2FR3CDR3FR4
atgagtcctgcccagttcctgtttctgttagtgctctggattcgggaaaccaacggtgatgttgtgatgacccagactccactcactttgtcggttaccattggacaaccagcctccatctcttgcaagtcaagtcagagcctcttacatagtgatggaaagacatatttgatttggttgttacagaggccaggccagtctccaaagcgcctaatctatctggtgtctaaactggactctggagtccctgacaggttcaccggcagtggatcagggacagatttcacactgaaaatcagcagagtggaggctgaggatttgggagtttatttttgctgtcaaggtacacattttccgtggacgttcggtggaggcaccatgctggaaatcaaa

SEQ ID NO: 1069 - protein, 131 aa, Artificial Sequence; identical to SEQ ID NO: 973
  Mouse antibody 28F9 Light chain: Amino acid sequence (131 aa) - Signal peptideFR1CDR1FR2CDR2FR3CDR3FR4

SEQ ID NO: 1070 - DNA, 69 bp, Artificial Sequence; identical to SEQ ID NO: 1038
  Mouse antibody 28F9 light chain variable framework 1 (FW1) sequence

SEQ ID NO: 1071 - protein, 23 aa, Artificial Sequence
  Mouse antibody 28F9 light chain variable framework 1 (FW1) sequence
DVVMTQTPLTLSVTIGQPASISC

SEQ ID NO: 1072 - DNA, 48 bp, Artificial Sequence; identical to SEQ ID NO: 976
  Mouse antibody 28F9 light chain variable complementarity determining regions 1 (CDR1) sequence

SEQ ID NO: 1073 - protein, 16 aa, Artificial Sequence
  Mouse antibody 28F9 light chain variable complementarity determining regions 1 (CDR1) sequence
KSSQSLLHSDGKTYLI

SEQ ID NO: 1074 - DNA, 45 bp, Artificial Sequence; identical to SEQ ID NO: 978
  Mouse antibody 28F9 light chain variable framework 2 (FW2) sequence

SEQ ID NO: 1075 - protein, 15 aa, Artificial Sequence
  Mouse antibody 28F9 light chain variable framework 2 (FW2) sequence
WLLQRPGQSPKRLIY

SEQ ID NO: 1076 - DNA, 21 bp, Artificial Sequence
  Mouse antibody 28F9 light chain variable complementarity determining regions 2 (CDR2) sequence
ctggtgtctaaactggactct

SEQ ID NO: 1077 - protein, 7 aa, Artificial Sequence
  Mouse antibody 28F9 light chain variable complementarity determining regions 2 (CDR2) sequence
LVSKLDS

SEQ ID NO: 1078 - DNA, 96 bp, Artificial Sequence
  Mouse antibody 28F9 light chain variable framework 3 (FW3) sequence
ggagtccctgacaggttcaccggcagtggatcagggacagatttcacactgaaaatcagcagagtggaggctgaggatttgggagtttatttttgc

SEQ ID NO: 1079 - protein, 32 aa, Artificial Sequence; identical to SEQ ID NO: 983
  Mouse antibody 28F9 light chain variable framework 3 (FW3) sequence

SEQ ID NO: 1080 - DNA, 27 bp, Artificial Sequence
  Mouse antibody 28F9 light chain variable complementarity determining regions 3 (CDR3) sequence
tgtcaaggtacacattttccgtggacg

SEQ ID NO: 1081 - protein, 9 aa, Artificial Sequence
  Mouse antibody 28F9 light chain variable complementarity determining regions 3 (CDR3) sequence
CQGTHFPWT

SEQ ID NO: 1082 - DNA, 30 bp, Artificial Sequence; identical to SEQ ID NO: 986
  Mouse antibody 28F9 light chain variable framework 4 (FW4) sequence

SEQ ID NO: 1083 - protein, 10 aa, Artificial Sequence
  Mouse antibody 28F9 light chain variable framework 4 (FW4) sequence
FGGGTMLEIK

SEQ ID NO: 1084 - DNA, 411 bp, Artificial Sequence
  Mouse antibody 18B4 Heavy chain: DNA sequence (411 bp) - Signal sequenceFR1CDR1FR2CDR2FR3CDR3FR4
atgtacttgggactgaactatgtattcatagtttttctcttaaatggtgtccagagtgaagtgaaacttgaggagtctggaggaggcttggtgcaacctgggggatccatgaaactctcttgtgctgcctctggattcacttttaatgacgcctggatggactgggtccgccagtctccagagaaggggcttgagtgggttgctgaaattagaagcacagctaatattcatacaacatactatgctgagtctgtccaagggaggttcaccatctcaagagatgattccaaaagtagtgtctacctgcaaatgaacagcttgagagctgaagacactggcatttattattgtaccccattactctacggatttgcttactggggccaagggactctggtcactgtctctgca

SEQ ID NO: 1085 - protein, 137 aa, Artificial Sequence
  Mouse antibody 18B4 Heavy chain: Amino acid sequence (137 aa) - Signal peptideFR1CDR1FR2CDR2FR3CDR3FR4
MYLGLNYVFIVFLLNGVQSEVKLEESGGGLVQPGGSMKLSCAASGFTFNDAWMDWVRQSPEKGLEWVAEIRSTANIHTTYYAESVQGRFTISRDDSKSSVYLQMNSLRAEDTGIYYCTPLLYGFAYWGQGTLVTVSA

SEQ ID NO: 1086 - DNA, 90 bp, Artificial Sequence
  Mouse antibody 18B4 heavy chain variable framework 1 (FW1) sequence
gaagtgaaacttgaggagtctggaggaggcttggtgcaacctgggggatccatgaaactctcttgtgctgcctctggattcacttttaat

SEQ ID NO: 1087 - protein, 30 aa, Artificial Sequence
  Mouse antibody 18B4 heavy chain variable framework 1 (FW1) sequence
EVKLEESGGGLVQPGGSMKLSCAASGFTFN

SEQ ID NO: 1088 - DNA, 15 bp, Artificial Sequence
  Mouse antibody 18B4 heavy chain variable complementarity determining regions 1 (CDR1) sequence
gacgcctggatggac

SEQ ID NO: 1089 - protein, 5 aa, Artificial Sequence
  Mouse antibody 18B4 heavy chain variable complementarity determining regions 1 (CDR1) sequence
DAWMD

SEQ ID NO: 1090 - DNA, 42 bp, Artificial Sequence
  Mouse antibody 18B4 heavy chain variable framework 2 (FW2) sequence
tgggtccgccagtctccagagaaggggcttgagtgggttgct

SEQ ID NO: 1091 - protein, 14 aa, Artificial Sequence
  Mouse antibody 18B4 heavy chain variable framework 2 (FW2) sequence
WVRQSPEKGLEWVA

SEQ ID NO: 1092 - DNA, 57 bp, Artificial Sequence
  Mouse antibody 18B4 heavy chain variable complementarity determining regions 2 (CDR2) sequence
gaaattagaagcacagctaatattcatacaacatactatgctgagtctgtccaaggg

SEQ ID NO: 1093 - protein, 19 aa, Artificial Sequence
  Mouse antibody 18B4 heavy chain variable complementarity determining regions 2 (CDR2) sequence
EIRSTANIHTTYYAESVQG

SEQ ID NO: 1094 - DNA, 96 bp, Artificial Sequence
  Mouse antibody 18B4 heavy chain variable framework 3 (FW3) sequence
aggttcaccatctcaagagatgattccaaaagtagtgtctacctgcaaatgaacagcttgagagctgaagacactggcatttattattgtacccca

SEQ ID NO: 1095 - protein, 32 aa, Artificial Sequence
  Mouse antibody 18B4 heavy chain variable framework 3 (FW3) sequence
RFTISRDDSKSSVYLQMNSLRAEDTGIYYCTP

SEQ ID NO: 1096 - DNA, 21 bp, Artificial Sequence
  Mouse antibody 18B4 heavy chain variable complementarity determining regions 3 (CDR3) sequence
ttactctacggatttgcttac

SEQ ID NO: 1097 - protein, 7 aa, Artificial Sequence
  Mouse antibody 18B4 heavy chain variable complementarity determining regions 3 (CDR3) sequence
LLYGFAY

SEQ ID NO: 1098 - DNA, 33 bp, Artificial Sequence; identical to SEQ ID NO: 843
  Mouse antibody 18B4 heavy chain variable framework 4 (FW4) sequence

SEQ ID NO: 1099 - protein, 11 aa, Artificial Sequence
  Mouse antibody 18B4 heavy chain variable framework 4 (FW4) sequence
WGQGTLVTVSA

SEQ ID NO: 1100 - DNA, 393 bp, Artificial Sequence
  Mouse antibody 18B4 Light chain: DNA sequence (393 bp) - Signal sequenceFR1CDR1FR2CDR2FR3CDR3FR4
atgaagttgcctgttaggctgttggtgctgatgttctggattcctgcttccagcagtgatgttgtgatgacccaaagtccactctccctgcctgtcagtcttggagatcaagcctccatctcttgcagaactagtcagagccttgtacacagtaatggaaacacctatttacattggcacctgcagaagccaggccagtctccaaaggtcctgatctacaaagtttccagccgattttctggggtcccagacaggttcagtggcagtggatcggggacagatttcacactcaagatcagcagagtggaggctgaggatctgggagtttatttctgctctcaaaatacacatgttccgtacacgttcggaggggggaccaagctggaaataaaa

SEQ ID NO: 1101 - protein, 131 aa, Artificial Sequence
  Mouse antibody 18B4 Light chain: Amino acid sequence (131 aa) - Signal peptideFR1CDR1FR2CDR2FR3CDR3FR4
MKLPVRLLVLMFWIPASSSDVVMTQSPLSLPVSLGDQASISCRTSQSLVHSNGNTYLHWHLQKPGQSPKVLIYKVSSRFSGVPDRFSGSGSGTDFTLKISRVEAEDLGVYFCSQNTHVPYTFGGGTKLEIK

SEQ ID NO: 1102 - DNA, 69 bp, Artificial Sequence
  Mouse antibody 18B4 light chain variable framework 1 (FW1) sequence
gatgttgtgatgacccaaagtccactctccctgcctgtcagtcttggagatcaagcctccatctcttgc

SEQ ID NO: 1103 - protein, 23 aa, Artificial Sequence
  Mouse antibody 18B4 light chain variable framework 1 (FW1) sequence
DVVMTQSPLSLPVSLGDQASISC

SEQ ID NO: 1104 - DNA, 48 bp, Artificial Sequence
  Mouse antibody 18B4 light chain variable complementarity determining regions 1 (CDR1) sequence
agaactagtcagagccttgtacacagtaatggaaacacctatttacat

SEQ ID NO: 1105 - protein, 16 aa, Artificial Sequence
  Mouse antibody 18B4 light chain variable complementarity determining regions 1 (CDR1) sequence
RTSQSLVHSNGNTYLH

SEQ ID NO: 1106 - DNA, 45 bp, Artificial Sequence
  Mouse antibody 18B4 light chain variable framework 2 (FW2) sequence
tggcacctgcagaagccaggccagtctccaaaggtcctgatctac

SEQ ID NO: 1107 - protein, 15 aa, Artificial Sequence
  Mouse antibody 18B4 light chain variable framework 2 (FW2) sequence
WHLQKPGQSPKVLIY

SEQ ID NO: 1108 - DNA, 21 bp, Artificial Sequence
  Mouse antibody 18B4 light chain variable complementarity determining regions 2 (CDR2) sequence
aaagtttccagccgattttct

SEQ ID NO: 1109 - protein, 7 aa, Artificial Sequence
  Mouse antibody 18B4 light chain variable complementarity determining regions 2 (CDR2) sequence
KVSSRFS

SEQ ID NO: 1110 - DNA, 96 bp, Artificial Sequence
  Mouse antibody 18B4 light chain variable framework 3 (FW3) sequence
ggggtcccagacaggttcagtggcagtggatcggggacagatttcacactcaagatcagcagagtggaggctgaggatctgggagtttatttctgc

SEQ ID NO: 1111 - protein, 32 aa, Artificial Sequence
  Mouse antibody 18B4 light chain variable framework 3 (FW3) sequence
GVPDRFSGSGSGTDFTLKISRVEAEDLGVYFC

SEQ ID NO: 1112 - DNA, 27 bp, Artificial Sequence
  Mouse antibody 18B4 light chain variable complementarity determining regions 3 (CDR3) sequence
tctcaaaatacacatgttccgtacacg

SEQ ID NO: 1113 - protein, 9 aa, Artificial Sequence
  Mouse antibody 18B4 light chain variable complementarity determining regions 3 (CDR3) sequence
SQNTHVPYT

SEQ ID NO: 1114 - DNA, 30 bp, Artificial Sequence
  Mouse antibody 18B4 light chain variable framework 4 (FW4) sequence
ttcggaggggggaccaagctggaaataaaa

SEQ ID NO: 1115 - protein, 10 aa, Artificial Sequence
  Mouse antibody 18B4 light chain variable framework 4 (FW4) sequence
FGGGTKLEIK

SEQ ID NO: 1116 - DNA, 408 bp, Artificial Sequence
  Mouse Antibody IE4 Heavy chain: DNA sequence (408 bp) - Signal sequenceFR1CDR1FR2CDR2FR3CDR3FR4
atggaatggccttgtatctttctcttcctcctgtcagtaactgaaggtgtccactcccaggttcagctgcagcagtctggggctgagctggtgaggcctgggtcctcagtgaagatttcctgtaaggcttctggctatgcattcagtacctactggatgaactgggtgaagcagaggcctggacagggtcttgagtggattggacagatttatcctggagatagtgatactaactacaatggaaagttcaagggtaaagccacactgactgcagacaagtcctccaacacagcctacatgcagctcagcagcctaacatctgaggactctgcggtctttttctgtgcaagaggtaaccacgcctctatggactactggggtcaaggaacctcagtcaccgtctcctca

SEQ ID NO: 1117 - protein, 136 aa, Artificial Sequence
  Mouse Antibody IE4 Heavy chain: Amino acid sequence (136 aa) - Signal peptideFR1CDR1FR2CDR2FR3CDR3FR4
MEWPCIFLFLLSVTEGVHSQVQLQQSGAELVRPGSSVKISCKASGYAFSTYWMNWVKQRPGQGLEWIGQIYPGDSDTNYNGKFKGKATLTADKSSNTAYMQLSSLTSEDSAVFFCARGNHASMDYWGQGTSVTVSS

SEQ ID NO: 1118 - DNA, 90 bp, Artificial Sequence
  Mouse Antibody IE4 heavy chain variable framework 1 (FW1) sequence
caggttcagctgcagcagtctggggctgagctggtgaggcctgggtcctcagtgaagatttcctgtaaggcttctggctatgcattcagt

SEQ ID NO: 1119 - protein, 30 aa, Artificial Sequence
  Mouse Antibody IE4 heavy chain variable framework 1 (FW1) sequence
QVQLQQSGAELVRPGSSVKISCKASGYAFS

SEQ ID NO: 1120-1199 - skipped (80 entries)

SEQ ID NO: 1200 - DNA, 15 bp, Artificial Sequence
  Mouse antibody IE4 heavy chain variable complementarity determining regions 1 (CDR1) sequence
acctactggatgaac

SEQ ID NO: 1201 - protein, 5 aa, Artificial Sequence
  Mouse antibody IE4 heavy chain variable complementarity determining regions 1 (CDR1) sequence
TYWMN

SEQ ID NO: 1202 - DNA, 42 bp, Artificial Sequence
  Mouse antibody IE4 heavy chain variable framework 2 (FW2) sequence
tgggtgaagcagaggcctggacagggtcttgagtggattgga

SEQ ID NO: 1203 - protein, 14 aa, Artificial Sequence
  Mouse antibody IE4 heavy chain variable framework 2 (FW2) sequence
WVKQRPGQGLEWIG

SEQ ID NO: 1204 - DNA, 51 bp, Artificial Sequence
  Mouse antibody IE4 heavy chain variable complementarity determining regions 2 (CDR2) sequence
cagatttatcctggagatagtgatactaactacaatggaaagttcaagggt

SEQ ID NO: 1205 - protein, 17 aa, Artificial Sequence
  Mouse antibody IE4 heavy chain variable complementarity determining regions 2 (CDR2) sequence
QIYPGDSDTNYNGKFKG

SEQ ID NO: 1206 - DNA, 96 bp, Artificial Sequence
  Mouse antibody IE4 heavy chain variable framework 3 (FW3) sequence
aaagccacactgactgcagacaagtcctccaacacagcctacatgcagctcagcagcctaacatctgaggactctgcggtctttttctgtgcaaga

SEQ ID NO: 1207 - protein, 32 aa, Artificial Sequence
  Mouse antibody IE4 heavy chain variable framework 3 (FW3) sequence
KATLTADKSSNTAYMQLSSLTSEDSAVFFCAR

SEQ ID NO: 1208 - DNA, 24 bp, Artificial Sequence
  Mouse antibody IE4 heavy chain variable complementarity determining regions 3 (CDR3) sequence
ggtaaccacgcctctatggactac

SEQ ID NO: 1209 - protein, 8 aa, Artificial Sequence
  Mouse antibody IE4 heavy chain variable complementarity determining regions 3 (CDR3) sequence
GNHASMDY

SEQ ID NO: 1210 - DNA, 33 bp, Artificial Sequence
  Mouse antibody IE4 heavy chain variable framework 4 (FW4) sequence
tggggtcaaggaacctcagtcaccgtctcctca

SEQ ID NO: 1211 - protein, 11 aa, Artificial Sequence
  Mouse antibody IE4 heavy chain variable framework 4 (FW4) sequence
WGQGTSVTVSS

SEQ ID NO: 1212 - DNA, 393 bp, Artificial Sequence
  Mouse Antibody IE4 Light chain: DNA sequence (393 bp) - Signal sequenceFR1CDR1FR2CDR2FR3CDR3FR4
atgaagttgcctgttaggctgttggtgctgatgttctggattcctgcttccagcagtgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaaaaacacatgttccgtggacgttcggtggaggcaccaagctggaaatcaaa

SEQ ID NO: 1213 - protein, 131 aa, Artificial Sequence
  Mouse Antibody IE4 Light chain: Amino acid sequence (131 aa) - Signal peptideFR1CDR1FR2CDR2FR3CDR3FR4
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQKTHVPWTFGGGTKLEIK

SEQ ID NO: 1214 - DNA, 69 bp, Artificial Sequence
  Mouse antibody IE4 light chain variable framework 1 (FW1) sequence
gatgttgtgatgacccaaactccactctccctgcctgtcagtcttggagatcaagcctccatctcttgc

SEQ ID NO: 1215 - protein, 23 aa, Artificial Sequence
  Mouse antibody IE4 light chain variable framework 1 (FW1) sequence
DVVMTQTPLSLPVSLGDQASISC

SEQ ID NO: 1216 - DNA, 48 bp, Artificial Sequence
  Mouse antibody IE4 light chain variable complementarity determining regions 1 (CDR1) sequence
agatctagtcagagccttgtacacagtaatggaaacacctatttacat

SEQ ID NO: 1217 - protein, 16 aa, Artificial Sequence
  Mouse antibody IE4 light chain variable complementarity determining regions 1 (CDR1) sequence
RSSQSLVHSNGNTYLH

SEQ ID NO: 1218 - DNA, 45 bp, Artificial Sequence
  Mouse antibody IE4 light chain variable framework 2 (FW2) sequence
tggtacctgcagaagccaggccagtctccaaagctcctgatctac

SEQ ID NO: 1219 - protein, 15 aa, Artificial Sequence
  Mouse antibody IE4 light chain variable framework 2 (FW2) sequence
WYLQKPGQSPKLLIY

SEQ ID NO: 1220 - DNA, 21 bp, Artificial Sequence
  Mouse antibody IE4 light chain variable complementarity determining regions 2 (CDR2) sequence
aaagtttccaaccgattttct

SEQ ID NO: 1221 - protein, 7 aa, Artificial Sequence
  Mouse antibody IE4 light chain variable complementarity determining regions 2 (CDR2) sequence
KVSNRFS

SEQ ID NO: 1222 - DNA, 96 bp, Artificial Sequence
  Mouse antibody IE4 light chain variable framework 3 (FW3) sequence
ggggtcccagacaggttcagtggcagtggatcagggacagatttcacactcaagatcagcagagtggaggctgaggatctgggagtttatttctgc

SEQ ID NO: 1223 - protein, 32 aa, Artificial Sequence; identical to SEQ ID NO: 1111
  Mouse antibody IE4 light chain variable framework 3 (FW3) sequence

SEQ ID NO: 1224 - DNA, 27 bp, Artificial Sequence
  Mouse antibody IE4 light chain variable complementarity determining regions 3 (CDR3) sequence
tctcaaaaaacacatgttccgtggacg

SEQ ID NO: 1225 - protein, 9 aa, Artificial Sequence
  Mouse antibody IE4 light chain variable complementarity determining regions 3 (CDR3) sequence
SQKTHVPWT

SEQ ID NO: 1226 - DNA, 30 bp, Artificial Sequence; identical to SEQ ID NO: 890
  Mouse antibody IE4 light chain variable framework 4 (FW4) sequence

SEQ ID NO: 1227 - protein, 10 aa, Artificial Sequence
  Mouse antibody IE4 light chain variable framework 4 (FW4) sequence
FGGGTKLEIK

SEQ ID NO: 1228 - DNA, 411 bp, Artificial Sequence
  Mouse antibody 29H1 Heavy chain: DNA sequence (411 bp) - Signal sequenceFR1CDR1FR2CDR2FR3CDR3FR4
atgtacttgggactgaactatgtattcatagtttttctcttaaatggtgtccagagtgaagtgaagcttgaggagtctggaggaggcttggtacaacctggaggatccatgaaactctcttgtgctgcctctggattcacttttagtgacgcctggatggactgggtccgccagtctccagagaaggggcttgaatgggttgctgaaattagaagcaaagctactaatcatgcaacatactatgctgagtctgtgaaagggaggttcaccatctcaagagatgattccaaaagtagtgtctacctgcaaatgaacagcttaagagctgaagacactggcatttattactgtacccccctactttacgggtttgcttactggggccaagggactctggtcactgtctctgca

SEQ ID NO: 1229 - protein, 137 aa, Artificial Sequence
  Mouse antibody 29H1 Heavy chain: Amino acid sequence (137 aa) - Signal peptideFR1CDR1FR2CDR2FR3CDR3FR4
MYLGLNYVFIVFLLNGVQSEVKLEESGGGLVQPGGSMKLSCAASGFTFSDAWMDWVRQSPEKGLEWVAEIRSKATNHATYYAESVKGRFTISRDDSKSSVYLQMNSLRAEDTGIYYCTPLLYGFAYWGQGTLVTVSA

SEQ ID NO: 1230 - DNA, 90 bp, Artificial Sequence
  Mouse antibody 29H1 heavy chain variable framework 1 (FW1) sequence
gaagtgaagcttgaggagtctggaggaggcttggtacaacctggaggatccatgaaactctcttgtgctgcctctggattcacttttagt

SEQ ID NO: 1231 - protein, 30 aa, Artificial Sequence
  Mouse antibody 29H1 heavy chain variable framework 1 (FW1) sequence
EVKLEESGGGLVQPGGSMKLSCAASGFTFS

SEQ ID NO: 1232 - DNA, 15 bp, Artificial Sequence
  Mouse antibody 29H1 heavy chain variable complementarity determining regions 1 (CDR1) sequence
gacgcctggatggac

SEQ ID NO: 1233 - protein, 5 aa, Artificial Sequence
  Mouse antibody 29H1 heavy chain variable complementarity determining regions 1 (CDR1) sequence
DAWMD

SEQ ID NO: 1234 - DNA, 42 bp, Artificial Sequence
  Mouse antibody 29H1 heavy chain variable framework 2 (FW2) sequence
tgggtccgccagtctccagagaaggggcttgaatgggttgct

SEQ ID NO: 1235 - protein, 14 aa, Artificial Sequence
  Mouse antibody 29H1 heavy chain variable framework 2 (FW2) sequence
WVRQSPEKGLEWVA

SEQ ID NO: 1236 - DNA, 57 bp, Artificial Sequence
  Mouse antibody 29H1 heavy chain variable complementarity determining regions 2 (CDR2) sequence
gaaattagaagcaaagctactaatcatgcaacatactatgctgagtctgtgaaaggg

SEQ ID NO: 1237 - protein, 19 aa, Artificial Sequence
  Mouse antibody 29H1 heavy chain variable complementarity determining regions 2 (CDR2) sequence
EIRSKATNHATYYAESVKG

SEQ ID NO: 1238 - DNA, 96 bp, Artificial Sequence
  Mouse antibody 29H1 heavy chain variable framework 3 (FW3) sequence
aggttcaccatctcaagagatgattccaaaagtagtgtctacctgcaaatgaacagcttaagagctgaagacactggcatttattactgtaccccc

SEQ ID NO: 1239 - protein, 32 aa, Artificial Sequence; identical to SEQ ID NO: 1095
  Mouse antibody 29H1 heavy chain variable framework 3 (FW3) sequence

SEQ ID NO: 1240 - DNA, 21 bp, Artificial Sequence
  Mouse antibody 29H1 heavy chain variable complementarity determining regions 3 (CDR3) sequence
ctactttacgggtttgcttac

SEQ ID NO: 1241 - protein, 7 aa, Artificial Sequence
  Mouse antibody 29H1 heavy chain variable complementarity determining regions 3 (CDR3) sequence
LLYGFAY

SEQ ID NO: 1242 - DNA, 33 bp, Artificial Sequence; identical to SEQ ID NO: 843
  Mouse antibody 29H1 heavy chain variable framework 4 (FW4) sequence

SEQ ID NO: 1243 - protein, 11 aa, Artificial Sequence
  Mouse antibody 29H1 heavy chain variable framework 4 (FW4) sequence
WGQGTLVTVSA

SEQ ID NO: 1244 - DNA, 393 bp, Artificial Sequence
  Mouse antibody 29H1 Light chain: DNA sequence (393 bp) - Signal sequenceFR1CDR1FR2CDR2FR3CDR3FR4
atgaagttgcctgttaggctgttggtgctgatgttctggattcctgcttccagcagtgatgttgtgatgacccaaactccactctccctgcctgtcagtcttggagatcaagcctccatctcttgcagatctggtcagagccttgtacacagtaatggacacacctatttacattggtacctgcagaagccaggccagtctccaaggctcctgatctacaaagtttccaaccgattttctggggtcccagacaggttcagtggcagtggatcaagggcagatttcacactcaagatcagcagagtggaggctgaggatctgggagtttatttctgctctcaaactacacatgttccgtggacgttcggtggaggcaccaagctggaaatcaaa

SEQ ID NO: 1245 - protein, 131 aa, Artificial Sequence
  Mouse antibody 29H1 Light chain: Amino acid sequence (131 aa) - Signal peptideFR1CDR1FR2CDR2FR3CDR3FR4
MKLPVRLLVLMFWIPASSSDVVMTQTPLSLPVSLGDQASISCRSGQSLVHSNGHTYLHWYLQKPGQSPRLLIYKVSNRFSGVPDRFSGSGSRADFTLKISRVEAEDLGVYFCSQTTHVPWTFGGGTKLEIK

SEQ ID NO: 1246 - DNA, 69 bp, Artificial Sequence; identical to SEQ ID NO: 1214
  Mouse antibody 29H1 light chain variable framework 1 (FW1) sequence

SEQ ID NO: 1247 - protein, 23 aa, Artificial Sequence
  Mouse antibody 29H1 light chain variable framework 1 (FW1) sequence
DVVMTQTPLSLPVSLGDQASISC

SEQ ID NO: 1248 - DNA, 48 bp, Artificial Sequence
  Mouse antibody 29H1 light chain variable complementarity determining regions 1 (CDR1) sequence
agatctggtcagagccttgtacacagtaatggacacacctatttacat

SEQ ID NO: 1249 - protein, 16 aa, Artificial Sequence
  Mouse antibody 29H1 light chain variable complementarity determining regions 1 (CDR1) sequence
RSGQSLVHSNGHTYLH

SEQ ID NO: 1250 - DNA, 45 bp, Artificial Sequence
  Mouse antibody 29H1 light chain variable framework 2 (FW2) sequence
tggtacctgcagaagccaggccagtctccaaggctcctgatctac

SEQ ID NO: 1251 - protein, 15 aa, Artificial Sequence
  Mouse antibody 29H1 light chain variable framework 2 (FW2) sequence
WYLQKPGQSPRLLIY

SEQ ID NO: 1252 - DNA, 21 bp, Artificial Sequence
  Mouse antibody 29H1 light chain variable complementarity determining regions 2 (CDR2) sequence
aaagtttccaaccgattttct

SEQ ID NO: 1253 - protein, 7 aa, Artificial Sequence
  Mouse antibody 29H1 light chain variable complementarity determining regions 2 (CDR2) sequence
KVSNRFS

SEQ ID NO: 1254 - DNA, 96 bp, Artificial Sequence
  Mouse antibody 29H1 light chain variable framework 3 (FW3) sequence
ggggtcccagacaggttcagtggcagtggatcaagggcagatttcacactcaagatcagcagagtggaggctgaggatctgggagtttatttctgc

SEQ ID NO: 1255 - protein, 32 aa, Artificial Sequence
  Mouse antibody 29H1 light chain variable framework 3 (FW3) sequence
GVPDRFSGSGSRADFTLKISRVEAEDLGVYFC

SEQ ID NO: 1256 - DNA, 27 bp, Artificial Sequence
  Mouse antibody 29H1 light chain variable complementarity determining regions 3 (CDR3) sequence
tctcaaactacacatgttccgtggacg

SEQ ID NO: 1257 - protein, 9 aa, Artificial Sequence
  Mouse antibody 29H1 light chain variable complementarity determining regions 3 (CDR3) sequence
SQTTHVPWT

SEQ ID NO: 1258 - DNA, 30 bp, Artificial Sequence; identical to SEQ ID NO: 890
  Mouse antibody 29H1 light chain variable framework 4 (FW4) sequence

SEQ ID NO: 1259 - protein, 10 aa, Artificial Sequence
  Mouse antibody 29H1 light chain variable framework 4 (FW4) sequence
FGGGTKLEIK

SEQ ID NO: 1260 - DNA, 399 bp, Artificial Sequence
  Mouse antibody 31A1 Heavy chain: DNA sequence (399 bp) - Signal sequenceFR1CDR1FR2CDR2FR3CDR3FR4
atggaaaggcactggatctttctcttcctgttttcagtaactgcaggtgtccactcccaggtccagcttcagcagtctggggctgaactggcaaaacctggggcctcagtgaagatgtcctgcaaggcttctggctacacctttactagctactggatgcactgggtaaaacagaggcctggacagggtctggaatggattggatacattaatcctagcactggttatactgagtacaatcagaagttcaaggacaaggccacattgactgcagacaaatcctccagcacagcctacatgcaactgagcagcctgacatctgaggactctgcagtctattactgtgcaagagcctacattgactactggggccaaggcaccactctcacagtctcctca

SEQ ID NO: 1261 - protein, 133 aa, Artificial Sequence
  Mouse antibody 31A1 Heavy chain: Amino acid sequence (133 aa) - Signal peptideFR1CDR1FR2CDR2FR3CDR3FR4
MERHWIFLFLFSVTAGVHSQVQLQQSGAELAKPGASVKMSCKASGYTFTSYWMHWVKQRPGQGLEWIGYINPSTGYTEYNQKFKDKATLTADKSSSTAYMQLSSLTSEDSAVYYCARAYIDYWGQGTTLTVSS

SEQ ID NO: 1262 - DNA, 90 bp, Artificial Sequence
  Mouse antibody 31A1 heavy chain variable framework 1 (FW1) sequence
caggtccagcttcagcagtctggggctgaactggcaaaacctggggcctcagtgaagatgtcctgcaaggcttctggctacacctttact

SEQ ID NO: 1263 - protein, 30 aa, Artificial Sequence
  Mouse antibody 31A1 heavy chain variable framework 1 (FW1) sequence
QVQLQQSGAELAKPGASVKMSCKASGYTFT

SEQ ID NO: 1264 - DNA, 15 bp, Artificial Sequence
  Mouse antibody 31A1 heavy chain variable complementarity determining regions 1 (CDR1) sequence
agctactggatgcac

SEQ ID NO: 1265 - protein, 5 aa, Artificial Sequence
  Mouse antibody 31A1 heavy chain variable complementarity determining regions 1 (CDR1) sequence
SYWMH

SEQ ID NO: 1266 - DNA, 42 bp, Artificial Sequence
  Mouse antibody 31A1 heavy chain variable framework 2 (FW2) sequence
tgggtaaaacagaggcctggacagggtctggaatggattgga

SEQ ID NO: 1267 - protein, 14 aa, Artificial Sequence
  Mouse antibody 31A1 heavy chain variable framework 2 (FW2) sequence
WVKQRPGQGLEWIG

SEQ ID NO: 1268 - DNA, 51 bp, Artificial Sequence
  Mouse antibody 31A1 heavy chain variable complementarity determining regions 2 (CDR2) sequence
tacattaatcctagcactggttatactgagtacaatcagaagttcaaggac

SEQ ID NO: 1269 - protein, 17 aa, Artificial Sequence
  Mouse antibody 31A1 heavy chain variable complementarity determining regions 2 (CDR2) sequence
YINPSTGYTEYNQKFKD

SEQ ID NO: 1270 - DNA, 96 bp, Artificial Sequence
  Mouse antibody 31A1 heavy chain variable framework 3 (FW3) sequence
aaggccacattgactgcagacaaatcctccagcacagcctacatgcaactgagcagcctgacatctgaggactctgcagtctattactgtgcaaga

SEQ ID NO: 1271 - protein, 32 aa, Artificial Sequence
  Mouse antibody 31A1 heavy chain variable framework 3 (FW3) sequence
KATLTADKSSSTAYMQLSSLTSEDSAVYYCAR

SEQ ID NO: 1272 - DNA, 15 bp, Artificial Sequence
  Mouse antibody 31A1 heavy chain variable complementarity determining regions 3 (CDR3) sequence
gcctacattgactac

SEQ ID NO: 1273 - protein, 5 aa, Artificial Sequence
  Mouse antibody 31A1 heavy chain variable complementarity determining regions 3 (CDR3) sequence
AYIDY

SEQ ID NO: 1274 - DNA, 33 bp, Artificial Sequence; identical to SEQ ID NO: 874
  Mouse antibody 31A1 heavy chain variable framework 4 (FW4) sequence

SEQ ID NO: 1275 - protein, 11 aa, Artificial Sequence
  Mouse antibody 31A1 heavy chain variable framework 4 (FW4) sequence
WGQGTTLTVSS

SEQ ID NO: 1276 - DNA, 393 bp, Artificial Sequence
  Mouse antibody 31A1 Light chain: DNA sequence (393 bp) - Signal sequenceFR1CDR1FR2CDR2FR3CDR3FR4
atgaagttgcctgttaggctgttggtgctgatgttctggattcctgcttccagcagtgatgttttgatgacccaaactccactctccctgcctgtcagtcttggagatcaagcctccttctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcaacagagtggaggctgaggatctgggagtttattactgctttcaagtttcacattttccgtggacgttcggtggaggcaccaagctggaaatcaaa

SEQ ID NO: 1277 - protein, 131 aa, Artificial Sequence
  Mouse antibody 31A1 Light chain: Amino acid sequence (131 aa) - Signal peptideFR1CDR1FR2CDR2FR3CDR3FR4
MKLPVRLLVLMFWIPASSSDVLMTQTPLSLPVSLGDQASFSCRSSQSIVHSNGNTYLEWYLQKPGQSPKLLIYKVSNRFSGVPDRFSGSGSGTDFTLKINRVEAEDLGVYYCFQVSHFPWTFGGGTKLEIK

SEQ ID NO: 1278 - DNA, 69 bp, Artificial Sequence
  Mouse antibody 31A1 light chain variable framework 1 (FW1) sequence
gatgttttgatgacccaaactccactctccctgcctgtcagtcttggagatcaagcctccttctcttgc

SEQ ID NO: 1279 - protein, 23 aa, Artificial Sequence
  Mouse antibody 31A1 light chain variable framework 1 (FW1) sequence
DVLMTQTPLSLPVSLGDQASFSC

SEQ ID NO: 1280 - DNA, 48 bp, Artificial Sequence; identical to SEQ ID NO: 880
  Mouse antibody 31A1 light chain variable complementarity determining regions 1 (CDR1) sequence

SEQ ID NO: 1281 - protein, 16 aa, Artificial Sequence
  Mouse antibody 31A1 light chain variable complementarity determining regions 1 (CDR1) sequence
RSSQSIVHRNGNTYLE

SEQ ID NO: 1282 - DNA, 45 bp, Artificial Sequence; identical to SEQ ID NO: 464
  Mouse antibody 31A1 light chain variable framework 2 (FW2) sequence

SEQ ID NO: 1283 - protein, 15 aa, Artificial Sequence
  Mouse antibody 31A1 light chain variable framework 2 (FW2) sequence
WYLQKPGQSPKLLIY

SEQ ID NO: 1284 - DNA, 21 bp, Artificial Sequence
  Mouse antibody 31A1 light chain variable complementarity determining regions 2 (CDR2) sequence
aaagtttccaaccgattttct

SEQ ID NO: 1285 - protein, 7 aa, Artificial Sequence
  Mouse antibody 31A1 light chain variable complementarity determining regions 2 (CDR2) sequence
KVSNRFS

SEQ ID NO: 1286 - DNA, 96 bp, Artificial Sequence; identical to SEQ ID NO: 468
  Mouse antibody 31A1 light chain variable framework 3 (FW3) sequence

SEQ ID NO: 1287 - protein, 32 aa, Artificial Sequence; identical to SEQ ID NO: 469
  Mouse antibody 31A1 light chain variable framework 3 (FW3) sequence

SEQ ID NO: 1288 - DNA, 27 bp, Artificial Sequence
  Mouse antibody 31A1 light chain variable complementarity determining regions 3 (CDR3) sequence
tttcaagtttcacattttccgtggacg

SEQ ID NO: 1289 - protein, 9 aa, Artificial Sequence
  Mouse antibody 31A1 light chain variable complementarity determining regions 3 (CDR3) sequence
FQVSHFPWT

SEQ ID NO: 1290 - DNA, 30 bp, Artificial Sequence; identical to SEQ ID NO: 890
  Mouse antibody 31A1 light chain variable framework 4 (FW4) sequence

SEQ ID NO: 1291 - protein, 10 aa, Artificial Sequence
  Mouse antibody 31A1 light chain variable framework 4 (FW4) sequence
FGGGTKLEIK

SEQ ID NO: 1292 - DNA, 411 bp, Artificial Sequence
  Mouse antibody 32C1 Heavy chain: DNA sequence (411 bp) - Signal sequenceFR1CDR1FR2CDR2FR3CDR3FR4
atgtacttgggactgaactgtgtattcatagtttttctcttaaaaggtgtccagagtgaagtgaagcttgaggagtctggaggaggcttggtgcaatctggaggatccatgaaactctcctgtgttgcctctggattcactttcagtaattactggatgaactgggtccgccagtctccagagaaggggcttgagtgggttgctgaaattagattgaaatctaataattatgcaatacattatgcggagtctgtgaaggggaggttcaccatctcaagagatgattccaaaagtagtgtctacctgcaaatgaacaacttaagagctgaagacactggcatttattactgtaccagggtcccgggactggatgcttactggggccaagggactctggtcactgtctctgca

SEQ ID NO: 1293 - protein, 137 aa, Artificial Sequence
  Mouse antibody 32C1 Heavy chain: Amino acid sequence (137 aa) - Signal peptideFR1CDR1FR2CDR2FR3CDR3FR4
MYLGLNCVFIVFLLKGVQSEVKLEESGGGLVQSGGSMKLSCVASGFTFSNYWMNWVRQSPEKGLEWVAEIRLKSNNYAIHYAESVKGRFTISRDDSKSSVYLQMNNLRAEDTGIYYCTRVPGLDAYWGQGTLVTVSA

SEQ ID NO: 1294 - DNA, 90 bp, Artificial Sequence
  Mouse antibody 32C1 heavy chain variable framework 1 (FW1) sequence
gaagtgaagcttgaggagtctggaggaggcttggtgcaatctggaggatccatgaaactctcctgtgttgcctctggattcactttcagt

SEQ ID NO: 1295 - protein, 30 aa, Artificial Sequence
  Mouse antibody 32C1 heavy chain variable framework 1 (FW1) sequence
EVKLEESGGGLVQSGGSMKLSCVASGFTFS

SEQ ID NO: 1296 - DNA, 15 bp, Artificial Sequence
  Mouse antibody 32C1 heavy chain variable complementarity determining regions 1 (CDR1) sequence
aattactggatgaac

SEQ ID NO: 1297 - protein, 5 aa, Artificial Sequence
  Mouse antibody 32C1 heavy chain variable complementarity determining regions 1 (CDR1) sequence
NYWMN

SEQ ID NO: 1298 - DNA, 42 bp, Artificial Sequence; identical to SEQ ID NO: 1090
  Mouse antibody 32C1 heavy chain variable framework 2 (FW2) sequence

SEQ ID NO: 1299 - protein, 14 aa, Artificial Sequence
  Mouse antibody 32C1 heavy chain variable framework 2 (FW2) sequence
WVRQSPEKGLEWVA

SEQ ID NO: 1300 - DNA, 57 bp, Artificial Sequence
  Mouse antibody 32C1 heavy chain variable complementarity determining regions 2 (CDR2) sequence
gaaattagattgaaatctaataattatgcaatacattatgcggagtctgtgaagggg

SEQ ID NO: 1301 - protein, 19 aa, Artificial Sequence
  Mouse antibody 32C1 heavy chain variable complementarity determining regions 2 (CDR2) sequence
EIRLKSNNYAIHYAESVKG

SEQ ID NO: 1302 - DNA, 96 bp, Artificial Sequence
  Mouse antibody 32C1 heavy chain variable framework 3 (FW3) sequence
aggttcaccatctcaagagatgattccaaaagtagtgtctacctgcaaatgaacaacttaagagctgaagacactggcatttattactgtaccagg

SEQ ID NO: 1303 - protein, 32 aa, Artificial Sequence
  Mouse antibody 32C1 heavy chain variable framework 3 (FW3) sequence
RFTISRDDSKSSVYLQMNNLRAEDTGIYYCTR

SEQ ID NO: 1304 - DNA, 21 bp, Artificial Sequence
  Mouse antibody 32C1 heavy chain variable complementarity determining regions 3 (CDR3) sequence
gtcccgggactggatgcttac

SEQ ID NO: 1305 - protein, 7 aa, Artificial Sequence
  Mouse antibody 32C1 heavy chain variable complementarity determining regions 3 (CDR3) sequence
VPGLDAY

SEQ ID NO: 1306 - DNA, 33 bp, Artificial Sequence; identical to SEQ ID NO: 843
  Mouse antibody 32C1 heavy chain variable framework 4 (FW4) sequence

SEQ ID NO: 1307 - protein, 11 aa, Artificial Sequence
  Mouse antibody 32C1 heavy chain variable framework 4 (FW4) sequence
WGQGTLVTVSA

SEQ ID NO: 1308 - DNA, 393 bp, Artificial Sequence
  Mouse antibody 32C1 Light chain: DNA sequence (393 bp) - Signal sequenceFR1CDR1FR2CDR2FR3CDR3FR4
atgaagttgcctgttaggctgttggtgctgatgttctggattcctgcttccagcagtgatgttgtgatgacccaaactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagtgtggaggctgaggatctgggagtttatttctgctctcaaattacacatgttccgtacacgttcggaggggggaccaatctggaaataaaa

SEQ ID NO: 1309 - protein, 131 aa, Artificial Sequence
  Mouse antibody 32C1 Light chain: Amino acid sequence (131 aa) - Signal peptideFR1CDR1FR2CDR2FR3CDR3FR4
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISSVEAEDLGVYFCSQITHVPYTFGGGTNLEIK

SEQ ID NO: 1310 - DNA, 69 bp, Artificial Sequence; identical to SEQ ID NO: 1214
  Mouse antibody 32C1 light chain variable framework 1 (FW1) sequence

SEQ ID NO: 1311 - protein, 23 aa, Artificial Sequence
  Mouse antibody 32C1 light chain variable framework 1 (FW1) sequence
DVVMTQTPLSLPVSLGDQASISC

SEQ ID NO: 1312 - DNA, 48 bp, Artificial Sequence; identical to SEQ ID NO: 1216
  Mouse antibody 32C1 light chain variable complementarity determining regions 1 (CDR1) sequence

SEQ ID NO: 1313 - protein, 16 aa, Artificial Sequence
  Mouse antibody 32C1 light chain variable complementarity determining regions 1 (CDR1) sequence
RSSQSLVHSNGNTYLH

SEQ ID NO: 1314 - DNA, 45 bp, Artificial Sequence; identical to SEQ ID NO: 1218
  Mouse antibody 32C1 light chain variable framework 2 (FW2) sequence

SEQ ID NO: 1315 - protein, 15 aa, Artificial Sequence
  Mouse antibody 32C1 light chain variable framework 2 (FW2) sequence
WYLQKPGQSPKLLIY

SEQ ID NO: 1316 - DNA, 21 bp, Artificial Sequence
  Mouse antibody 32C1 light chain variable complementarity determining regions 2 (CDR2) sequence
aaagtttccaaccgattttct

SEQ ID NO: 1317 - protein, 7 aa, Artificial Sequence
  Mouse antibody 32C1 light chain variable complementarity determining regions 2 (CDR2) sequence
KVSNRFS

SEQ ID NO: 1318 - DNA, 96 bp, Artificial Sequence
  Mouse antibody 32C1 light chain variable framework 3 (FW3) sequence
ggggtcccagacaggttcagtggcagtggatcagggacagatttcacactcaagatcagcagtgtggaggctgaggatctgggagtttatttctgc

SEQ ID NO: 1319 - protein, 32 aa, Artificial Sequence
  Mouse antibody 32C1 light chain variable framework 3 (FW3) sequence
GVPDRFSGSGSGTDFTLKISSVEAEDLGVYFC

SEQ ID NO: 1320 - DNA, 27 bp, Artificial Sequence
  Mouse antibody 32C1 light chain variable complementarity determining regions 3 (CDR3) sequence
tctcaaattacacatgttccgtacacg

SEQ ID NO: 1321 - protein, 9 aa, Artificial Sequence
  Mouse antibody 32C1 light chain variable complementarity determining regions 3 (CDR3) sequence
SQITHVPYT

SEQ ID NO: 1322 - DNA, 30 bp, Artificial Sequence
  Mouse antibody 32C1 light chain variable framework 4 (FW4) sequence
ttcggaggggggaccaatctggaaataaaa

SEQ ID NO: 1323 - protein, 10 aa, Artificial Sequence
  Mouse antibody 32C1 light chain variable framework 4 (FW4) sequence
FGGGTNLEIK

SEQ ID NO: 1324 - DNA, 423 bp, Artificial Sequence
  Mouse antibody 45C11 Heavy chain: DNA sequence (423 bp) - Signal sequenceFR1CDR1FR2CDR2FR3CDR3FR4
atgaaatgcagctgggttatcttcttcctgatggcagtggttacaggggtcaattcagaggttcagctgcagcagtctggggcagaccttgtgaagccaggggcctcagtcaagttgtcctgcacagcttctggcttcaacattaaagacacctttatgcactgggtgaagcagaggcctgaacagggcctggagtggattggaaggattgatcctgcgaatggtaatactaaatatgacccgaaattccagggcaaggccactataacagcagacacatcctccaacacagcctacctgcagctcagcagcctgacatctgaggacactgccgtctattactgtgctaaaccgtatggtaactacggctattactatgctttggactactggggtcaaggaacctcagtcaccgtctcctca

SEQ ID NO: 1325 - protein, 141 aa, Artificial Sequence
  Mouse antibody 45C11 Heavy chain: Amino acid sequence (141 aa) - Signal peptideFR1CDR1FR2CDR2FR3CDR3FR4
MKCSWVIFFLMAVVTGVNSEVQLQQSGADLVKPGASVKLSCTASGFNIKDTFMHWVKQRPEQGLEWIGRIDPANGNTKYDPKFQGKATITADTSSNTAYLQLSSLTSEDTAVYYCAKPYGNYGYYYALDYWGQGTSVTVSS

SEQ ID NO: 1326 - DNA, 90 bp, Artificial Sequence
  Mouse antibody 45C11 heavy chain variable framework 1 (FW1) sequence
gaggttcagctgcagcagtctggggcagaccttgtgaagccaggggcctcagtcaagttgtcctgcacagcttctggcttcaacattaaa

SEQ ID NO: 1327 - protein, 30 aa, Artificial Sequence
  Mouse antibody 45C11 heavy chain variable framework 1 (FW1) sequence
EVQLQQSGADLVKPGASVKLSCTASGFNIK

SEQ ID NO: 1328 - DNA, 15 bp, Artificial Sequence
  Mouse antibody 45C11 heavy chain variable complementarity determining regions 1 (CDR1) sequence
gacacctttatgcac

SEQ ID NO: 1329 - protein, 5 aa, Artificial Sequence
  Mouse antibody 45C11 heavy chain variable complementarity determining regions 1 (CDR1) sequence
DTFMH

SEQ ID NO: 1330 - DNA, 42 bp, Artificial Sequence
  Mouse antibody 45C11 heavy chain variable framework 2 (FW2) sequence
tgggtgaagcagaggcctgaacagggcctggagtggattgga

SEQ ID NO: 1331 - protein, 14 aa, Artificial Sequence
  Mouse antibody 45C11 heavy chain variable framework 2 (FW2) sequence
WVKQRPEQGLEWIG

SEQ ID NO: 1332 - DNA, 51 bp, Artificial Sequence
  Mouse antibody 45C11 heavy chain variable complementarity determining regions 2 (CDR2) sequence
aggattgatcctgcgaatggtaatactaaatatgacccgaaattccagggc

SEQ ID NO: 1333 - protein, 17 aa, Artificial Sequence
  Mouse antibody 45C11 heavy chain variable complementarity determining regions 2 (CDR2) sequence
RIDPANGNTKYDPKFQG

SEQ ID NO: 1334 - DNA, 96 bp, Artificial Sequence
  Mouse antibody 45C11 heavy chain variable framework 3 (FW3) sequence
aaggccactataacagcagacacatcctccaacacagcctacctgcagctcagcagcctgacatctgaggacactgccgtctattactgtgctaaa

SEQ ID NO: 1335 - protein, 32 aa, Artificial Sequence
  Mouse antibody 45C11 heavy chain variable framework 3 (FW3) sequence
KATITADTSSNTAYLQLSSLTSEDTAVYYCAK

SEQ ID NO: 1336 - DNA, 39 bp, Artificial Sequence
  Mouse antibody 45C11 heavy chain variable complementarity determining regions 3 (CDR3) sequence
ccgtatggtaactacggctattactatgctttggactac

SEQ ID NO: 1337 - protein, 13 aa, Artificial Sequence
  Mouse antibody 45C11 heavy chain variable complementarity determining regions 3 (CDR3) sequence
PYGNYGYYYALDY

SEQ ID NO: 1338 - DNA, 33 bp, Artificial Sequence; identical to SEQ ID NO: 1210
  Mouse antibody 45C11 heavy chain variable framework 4 (FW4) sequence

SEQ ID NO: 1339 - protein, 11 aa, Artificial Sequence
  Mouse antibody 45C11 heavy chain variable framework 4 (FW4) sequence
WGQGTSVTVSS

SEQ ID NO: 1340 - DNA, 381 bp, Artificial Sequence
  Mouse antibody 45C11 Light chain: DNA sequence (381 bp) - Signal sequenceFR1CDR1FR2CDR2FR3CDR3FR4
atgaggttccaggttcaggttctggggctccttctgctctggatatcaggtgcccagtgtgatgtccagataacccagtctccatcttatcttgctgcatctcctggagaaaccattactattaattgcagggcaagtaagagcattagcaaatatttagcctggtatcaagagaaacctgggaaaactaataagcttcttatctactctggatccactttgcaatctggaattccatcaaggttcagtggcagtggatctggtacagatttcactctcaccatcagtagcctggagcctgaagattttgcaatgtattactgtcaacagcataatgaattcccgtggacgttcggtggaggcaccaagctggaaatcaaa

SEQ ID NO: 1341 - protein, 127 aa, Artificial Sequence
  Mouse antibody 45C11 Light chain: Amino acid sequence (127 aa) - Signal peptideFR1CDR1FR2CDR2FR3CDR3FR4
MRFQVQVLGLLLLWISGAQCDVQITQSPSYLAASPGETITINCRASKSISKYLAWYQEKPGKTNKLLIYSGSTLQSGIPSRFSGSGSGTDFTLTISSLEPEDFAMYYCQQHNEFPWTFGGGTKLEIK

SEQ ID NO: 1342 - DNA, 69 bp, Artificial Sequence
  Mouse antibody 45C11 light chain variable framework 1 (FW1) sequence
gatgtccagataacccagtctccatcttatcttgctgcatctcctggagaaaccattactattaattgc

SEQ ID NO: 1343 - protein, 23 aa, Artificial Sequence
  Mouse antibody 45C11 light chain variable framework 1 (FW1) sequence
DVQITQSPSYLAASPGETITINC

SEQ ID NO: 1344 - DNA, 33 bp, Artificial Sequence
  Mouse antibody 45C11 light chain variable complementarity determining regions 1 (CDR1) sequence
agggcaagtaagagcattagcaaatatttagcc

SEQ ID NO: 1345 - protein, 11 aa, Artificial Sequence
  Mouse antibody 45C11 light chain variable complementarity determining regions 1 (CDR1) sequence
RASKSISKYLA

SEQ ID NO: 1346 - DNA, 45 bp, Artificial Sequence
  Mouse antibody 45C11 light chain variable framework 2 (FW2) sequence
tggtatcaagagaaacctgggaaaactaataagcttcttatctac

SEQ ID NO: 1347 - protein, 15 aa, Artificial Sequence
  Mouse antibody 45C11 light chain variable framework 2 (FW2) sequence
WYQEKPGKTNKLLIY

SEQ ID NO: 1348 - DNA, 21 bp, Artificial Sequence
  Mouse antibody 45C11 light chain variable complementarity determining regions 2 (CDR2) sequence
tctggatccactttgcaatct

SEQ ID NO: 1349 - protein, 7 aa, Artificial Sequence
  Mouse antibody 45C11 light chain variable complementarity determining regions 2 (CDR2) sequence
SGSTLQS

SEQ ID NO: 1350 - DNA, 96 bp, Artificial Sequence
  Mouse antibody 45C11 light chain variable framework 3 (FW3) sequence
ggaattccatcaaggttcagtggcagtggatctggtacagatttcactctcaccatcagtagcctggagcctgaagattttgcaatgtattactgt

SEQ ID NO: 1351 - protein, 32 aa, Artificial Sequence
  Mouse antibody 45C11 light chain variable framework 3 (FW3) sequence
GIPSRFSGSGSGTDFTLTISSLEPEDFAMYYC

SEQ ID NO: 1352 - DNA, 27 bp, Artificial Sequence
  Mouse antibody 45C11 light chain variable complementarity determining regions 3 (CDR3) sequence
caacagcataatgaattcccgtggacg

SEQ ID NO: 1353 - protein, 9 aa, Artificial Sequence
  Mouse antibody 45C11 light chain variable complementarity determining regions 3 (CDR3) sequence
QQHNEFPWT

SEQ ID NO: 1354 - DNA, 30 bp, Artificial Sequence; identical to SEQ ID NO: 890
  Mouse antibody 45C11 light chain variable framework 4 (FW4) sequence

SEQ ID NO: 1355 - protein, 10 aa, Artificial Sequence
  Mouse antibody 45C11 light chain variable framework 4 (FW4) sequence
FGGGTKLEIK

SEQ ID NO: 1356 - DNA, 90 bp, Artificial Sequence; identical to SEQ ID NO: 990
  Mouse 5C6F3 heavy chain variable framework 1 (FW1) sequence

SEQ ID NO: 1357 - protein, 30 aa, Artificial Sequence; identical to SEQ ID NO: 991
  Mouse 5C6F3 heavy chain variable framework 1 (FW1) sequence

SEQ ID NO: 1358 - DNA, 15 bp, Artificial Sequence
  Mouse 5C6F3 heavy chain variable complementarity determining regions 1 (CDR1) sequence
acctatgccatgtct

SEQ ID NO: 1359 - protein, 5 aa, Artificial Sequence
  Mouse 5C6F3 heavy chain variable complementarity determining regions 1 (CDR1) sequence
TYAMS

SEQ ID NO: 1360 - DNA, 42 bp, Artificial Sequence; identical to SEQ ID NO: 124
  Mouse 5C6F3 heavy chain variable framework 2 (FW2) sequence

SEQ ID NO: 1361 - protein, 14 aa, Artificial Sequence
  Mouse 5C6F3 heavy chain variable framework 2 (FW2) sequence
WVRQTPEKRLEWVA

SEQ ID NO: 1362 - DNA, 51 bp, Artificial Sequence
  Mouse 5C6F3 heavy chain variable complementarity determining regions 2 (CDR2) sequence
gccattagtaatggtggtggttacacctactatccagacagtctgaagggg

SEQ ID NO: 1363 - protein, 17 aa, Artificial Sequence
  Mouse 5C6F3 heavy chain variable complementarity determining regions 2 (CDR2) sequence
AISNGGGYTYYPDSLKG

SEQ ID NO: 1364 - DNA, 96 bp, Artificial Sequence
  Mouse 5C6F3 heavy chain variable framework 3 (FW3) sequence
cgattcaccatctccagagacaatgccaagaacaccctgtacctgcaaatgagcagtctgaggtctgaggacacggccacgtattactgtgcaaga

SEQ ID NO: 1365 - protein, 32 aa, Artificial Sequence
  Mouse 5C6F3 heavy chain variable framework 3 (FW3) sequence
RFTISRDNAKNTLYLQMSSLRSEDTATYYCAR

SEQ ID NO: 1366 - DNA, 27 bp, Artificial Sequence
  Mouse 5C6F3 heavy chain variable complementarity determining regions 3 (CDR3) sequence
cgttactatgatcactactttgactac

SEQ ID NO: 1367 - protein, 9 aa, Artificial Sequence
  Mouse 5C6F3 heavy chain variable complementarity determining regions 3 (CDR3) sequence
RYYDHYFDY

SEQ ID NO: 1368 - DNA, 33 bp, Artificial Sequence
  Mouse 5C6F3 heavy chain variable framework 4 (FW4) sequence
tggggccaaggcaccgctctcacggtctcctca

SEQ ID NO: 1369 - protein, 11 aa, Artificial Sequence
  Mouse 5C6F3 heavy chain variable framework 4 (FW4) sequence
WGQGTALTVSS

SEQ ID NO: 1370 - DNA, 69 bp, Artificial Sequence; identical to SEQ ID NO: 460
  Mouse 5C6F3 light chain variable framework 1 (FR1) sequence

SEQ ID NO: 1371 - protein, 23 aa, Artificial Sequence
  Mouse 5C6F3 light chain variable framework 1 (FR1) sequence
DVLMTQTPLSLPVSLGDQASISC

SEQ ID NO: 1372 - DNA, 48 bp, Artificial Sequence; identical to SEQ ID NO: 462
  Mouse 5C6F3 light chain variable complementarity determining regions 1 (CDR1) sequence

SEQ ID NO: 1373 - protein, 16 aa, Artificial Sequence
  Mouse 5C6F3 light chain variable complementarity determining regions 1 (CDR1) sequence
RSSQTIVHSNGNTYLE

SEQ ID NO: 1374 - DNA, 45 bp, Artificial Sequence; identical to SEQ ID NO: 464
  Mouse 5C6F3 light chain variable framework 2 (FR2) sequence

SEQ ID NO: 1375 - protein, 15 aa, Artificial Sequence
  Mouse 5C6F3 light chain variable framework 2 (FR2) sequence
WYLQKPGQSPKLLIY

SEQ ID NO: 1376 - DNA, 21 bp, Artificial Sequence
  Mouse 5C6F3 light chain variable complementarity determining regions 2 (CDR2) sequence
aaagtttccaaccgattttct

SEQ ID NO: 1377 - protein, 7 aa, Artificial Sequence
  Mouse 5C6F3 light chain variable complementarity determining regions 2 (CDR2) sequence
KVSNRFS

SEQ ID NO: 1378 - DNA, 96 bp, Artificial Sequence
  Mouse 5C6F3 light chain variable framework 3 (FR3) sequence
ggggtcccagacaggttcagtggcagtggatcagggacagatttcacactcaagatcagcagggtggaggctgaggatctgggagtttattactgc

SEQ ID NO: 1379 - protein, 32 aa, Artificial Sequence; identical to SEQ ID NO: 887
  Mouse 5C6F3 light chain variable framework 3 (FR3) sequence

SEQ ID NO: 1380 - DNA, 27 bp, Artificial Sequence
  Mouse 5C6F3 light chain variable complementarity determining regions 3 (CDR3) sequence
tttcaagattcacatgttcctctcacg

SEQ ID NO: 1381 - protein, 9 aa, Artificial Sequence
  Mouse 5C6F3 light chain variable complementarity determining regions 3 (CDR3) sequence
FQDSHVPLT

SEQ ID NO: 1382 - DNA, 30 bp, Artificial Sequence; identical to SEQ ID NO: 1018
  Mouse 5C6F3 light chain variable framework 4 (FR4) sequence

SEQ ID NO: 1383 - protein, 10 aa, Artificial Sequence
  Mouse 5C6F3 light chain variable framework 4 (FR4) sequence
FGAGTKLELK

SEQ ID NO: 1384 - DNA, 735 bp, Artificial Sequence
  mu5C6F3 scFv sequence
gaagtgatgctggtggagtctgggggaggcttagtgaagcctggagggtccctgaaactctcctgtgcagcctctggattcactttcagtacctatgccatgtcttgggttcgccagactccggagaagaggctggagtgggtcgcagccattagtaatggtggtggttacacctactatccagacagtctgaaggggcgattcaccatctccagagacaatgccaagaacaccctgtacctgcaaatgagcagtctgaggtctgaggacacggccacgtattactgtgcaagacgttactatgatcactactttgactactggggccaaggcaccgctctcacggtctcctcaggtggcggaggatctggcggaggtggaagcggcggaggcggatccgatgttttgatgacccaaactccactctccctgcctgtcagtcttggagatcaagcctccatctcttgcagatctagtcagaccattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagggtggaggctgaggatctgggagtttattactgctttcaagattcacatgttcctctcacgttcggtgctgggaccaagctggagctgaaa

SEQ ID NO: 1385 - protein, 245 aa, Artificial Sequence
  mu5C6F3 scFv sequence
EVMLVESGGGLVKPGGSLKLSCAASGFTFSTYAMSWVRQTPEKRLEWVAAISNGGGYTYYPDSLKGRFTISRDNAKNTLYLQMSSLRSEDTATYYCARRYYDHYFDYWGQGTALTVSSGGGGSGGGGSGGGGSDVLMTQTPLSLPVSLGDQASISCRSSQTIVHSNGNTYLEWYLQKPGQSPKLLIYKVSNRFSGVPDRFSGSGSGTDFTLKISRVEAEDLGVYYCFQDSHVPLTFGAGTKLELK

SEQ ID NO: 1386 - DNA, 90 bp, Artificial Sequence
  Mouse 3C2B1 heavy chain variable framework 1 (CDR1) sequence
gaagtgatgctggtggagtctgggggaggcttagtgaagcctggagggtccctgaaactctcctgtgcagcctctggaatcactttcagt

SEQ ID NO: 1387 - protein, 30 aa, Artificial Sequence
  Mouse 3C2B1 heavy chain variable framework 1 (CDR1) sequence
EVMLVESGGGLVKPGGSLKLSCAASGITFS

SEQ ID NO: 1388 - DNA, 15 bp, Artificial Sequence
  Mouse 3C2B1 heavy chain variable complementarity determining regions 1 (CDR1) sequence
acctataccatgtcg

SEQ ID NO: 1389 - protein, 5 aa, Artificial Sequence
  Mouse 3C2B1 heavy chain variable complementarity determining regions 1 (CDR1) sequence
TYTMS

SEQ ID NO: 1390 - DNA, 42 bp, Artificial Sequence; identical to SEQ ID NO: 124
  Mouse 3C2B1 heavy chain variable framework 2 (CDR2) sequence

SEQ ID NO: 1391 - protein, 14 aa, Artificial Sequence
  Mouse 3C2B1 heavy chain variable framework 2 (CDR2) sequence
WVRQTPEKRLEWVA

SEQ ID NO: 1392 - DNA, 51 bp, Artificial Sequence
  Mouse 3C2B1 heavy chain variable complementarity determining regions 2 (CDR2) sequence
accattagtactggtggtgataaaacctactattcagacagtgtgaagggt

SEQ ID NO: 1393 - protein, 17 aa, Artificial Sequence
  Mouse 3C2B1 heavy chain variable complementarity determining regions 2 (CDR2) sequence
TISTGGDKTYYSDSVKG

SEQ ID NO: 1394 - DNA, 96 bp, Artificial Sequence
  Mouse 3C2B1 heavy chain variable framework 3 (CDR3) sequence
cgattcaccatctccagagacaatgccaagaacaacctgtacctccaaatgagcagtctgaggtctgaggacacggccttgtattactgtgcaagg

SEQ ID NO: 1395 - protein, 32 aa, Artificial Sequence
  Mouse 3C2B1 heavy chain variable framework 3 (CDR3) sequence
RFTISRDNAKNNLYLQMSSLRSEDTALYYCAR

SEQ ID NO: 1396 - DNA, 36 bp, Artificial Sequence
  Mouse 3C2B1 heavy chain variable complementarity determining regions 3 (CDR3) sequence
ggaaccacggctatgtattactatgctatggactac

SEQ ID NO: 1397 - protein, 12 aa, Artificial Sequence
  Mouse 3C2B1 heavy chain variable complementarity determining regions 3 (CDR3) sequence
GTTAMYYYAMDY

SEQ ID NO: 1398 - DNA, 33 bp, Artificial Sequence; identical to SEQ ID NO: 1210
  Mouse 3C2B1 heavy chain variable framework 4 (CDR4) sequence

SEQ ID NO: 1399 - protein, 11 aa, Artificial Sequence
  Mouse 3C2B1 heavy chain variable framework 4 (CDR4) sequence
WGQGTSVTVSS

SEQ ID NO: 1400 - DNA, 69 bp, Artificial Sequence
  Mouse 3C2B1 light chain variable framework 1 (FW1) sequence
gacattgtgctgacacagtctcctgcttccttagctgtatctctggggcagagggccaccatctcatgc

SEQ ID NO: 1401 - protein, 23 aa, Artificial Sequence
  Mouse 3C2B1 light chain variable framework 1 (FW1) sequence
DIVLTQSPASLAVSLGQRATISC

SEQ ID NO: 1402 - DNA, 45 bp, Artificial Sequence
  Mouse 3C2B1 light chain variable complementarity determining regions 1 (CDR1) sequence
agggccagcaaaagtatcagtacatctgactataattatattcac

SEQ ID NO: 1403 - protein, 15 aa, Artificial Sequence
  Mouse 3C2B1 light chain variable complementarity determining regions 1 (CDR1) sequence
RASKSISTSDYNYIH

SEQ ID NO: 1404 - DNA, 45 bp, Artificial Sequence
  Mouse 3C2B1 light chain variable framework 2 (FW2) sequence
tggtaccaacagaaaccaggacagccacccaaactcctcatctat

SEQ ID NO: 1405 - protein, 15 aa, Artificial Sequence
  Mouse 3C2B1 light chain variable framework 2 (FW2) sequence
WYQQKPGQPPKLLIY

SEQ ID NO: 1406 - DNA, 21 bp, Artificial Sequence
  Mouse 3C2B1 light chain variable complementarity determining regions 2 (CDR2) sequence
cttgcatccaacctagaatct

SEQ ID NO: 1407 - protein, 7 aa, Artificial Sequence
  Mouse 3C2B1 light chain variable complementarity determining regions 2 (CDR2) sequence
LASNLES

SEQ ID NO: 1408 - DNA, 95 bp, Artificial Sequence
  Mouse 3C2B1 light chain variable framework 3 (FW3) sequence
gggtccctgccaggttcagtggcagtgggtctgggacagacttcaccctcaacatccatcctgtggaggaagaagatgctgcaacctattactgt

SEQ ID NO: 1409 - protein, 32 aa, Artificial Sequence; identical to SEQ ID NO: 179
  Mouse 3C2B1 light chain variable framework 3 (FW3) sequence

SEQ ID NO: 1410 - DNA, 27 bp, Artificial Sequence
  Mouse 3C2B1 light chain variable complementarity determining regions 3 (CDR3) sequence
cagcacagtagggagcttcctctcacg

SEQ ID NO: 1411 - protein, 9 aa, Artificial Sequence
  Mouse 3C2B1 light chain variable complementarity determining regions 3 (CDR3) sequence
QHSRELPLT

SEQ ID NO: 1412 - DNA, 30 bp, Artificial Sequence; identical to SEQ ID NO: 1018
  Mouse 3C2B1 light chain variable framework 4 (FW4) sequence

SEQ ID NO: 1413 - protein, 10 aa, Artificial Sequence
  Mouse 3C2B1 light chain variable framework 4 (FW4) sequence
FGAGTKLELK

SEQ ID NO: 1414 - DNA, 90 bp, Artificial Sequence
  Mouse B12 heavy chain variable framework 1 (FW1) sequence
caggcgcagctgaaggagtcaggacctggcctggtggcgccctcacagagcctgtccatcacttgcactgtctctgggttttcattaacc

SEQ ID NO: 1415 - protein, 30 aa, Artificial Sequence
  Mouse B12 heavy chain variable framework 1 (FW1) sequence
QAQLKESGPGLVAPSQSLSITCTVSGFSLT

SEQ ID NO: 1416 - DNA, 15 bp, Artificial Sequence
  Mouse B12 heavy chain variable complementarity determining regions 1 (CDR1) sequence
agctatggtgtacac

SEQ ID NO: 1417 - protein, 5 aa, Artificial Sequence
  Mouse B12 heavy chain variable complementarity determining regions 1 (CDR1) sequence
SYGVH

SEQ ID NO: 1418 - DNA, 42 bp, Artificial Sequence
  Mouse B12 heavy chain variable framework 2 (FW2) sequence
tgggttcgccagcctccaggaaagggtctggagtggctggga

SEQ ID NO: 1419 - protein, 14 aa, Artificial Sequence
  Mouse B12 heavy chain variable framework 2 (FW2) sequence
WVRQPPGKGLEWLG

SEQ ID NO: 1420 - DNA, 54 bp, Artificial Sequence
  Mouse B12 heavy chain variable complementarity determining regions 2 (CDR2) sequence
gtaatatggcctggtggaagcacaaattataattcgactctcatgtccagaatg

SEQ ID NO: 1421 - protein, 18 aa, Artificial Sequence
  Mouse B12 heavy chain variable complementarity determining regions 2 (CDR2) sequence
VIWPGGSTNYNSTLMSRM

SEQ ID NO: 1422 - DNA, 90 bp, Artificial Sequence
  Mouse B12 heavy chain variable framework 3 (FW3) sequence
cggatcatcaaagacaactccaagagccaagttttcttaaaaatgaacagtctgcaaattgatgacacagccatgtactactgtgccaga

SEQ ID NO: 1423 - protein, 30 aa, Artificial Sequence
  Mouse B12 heavy chain variable framework 3 (FW3) sequence
RIIKDNSKSQVFLKMNSLQIDDTAMYYCAR

SEQ ID NO: 1424 - DNA, 36 bp, Artificial Sequence
  Mouse B12 heavy chain variable complementarity determining regions 3 (CDR3) sequence
gatcggacacctcgggtgggggcctggtttgcttac

SEQ ID NO: 1425 - protein, 12 aa, Artificial Sequence
  Mouse B12 heavy chain variable complementarity determining regions 3 (CDR3) sequence
DRTPRVGAWFAY

SEQ ID NO: 1426 - DNA, 34 bp, Artificial Sequence
  Mouse B12 heavy chain variable framework 4 (FW4) sequence
tggggccaagggactctggtcactgtctctgcag

SEQ ID NO: 1427 - protein, 11 aa, Artificial Sequence
  Mouse B12 heavy chain variable framework 4 (FW4) sequence
WGQGTLVTVSA

SEQ ID NO: 1428 - DNA, 69 bp, Artificial Sequence
  Mouse B12 light chain variable framework 1 (FR1) sequence
atcattgtgctgacccaatctccagcttctttggctgtgtctctagggcagagggccaccatatcctgc

SEQ ID NO: 1429 - protein, 23 aa, Artificial Sequence
  Mouse B12 light chain variable framework 1 (FR1) sequence
IIVLTQSPASLAVSLGQRATISC

SEQ ID NO: 1430 - DNA, 45 bp, Artificial Sequence
  Mouse B12 light chain variable complementarity determining regions 1 (CDR1) sequence
agagccagtgagagtgttgctacttatggcaataattttatgcag

SEQ ID NO: 1431 - protein, 15 aa, Artificial Sequence
  Mouse B12 light chain variable complementarity determining regions 1 (CDR1) sequence
RASESVATYGNNFMQ

SEQ ID NO: 1432 - DNA, 90 bp, Artificial Sequence
  Mouse B2 heavy chain variable framework 1 (FW1) sequence
gaagtggtgctggtggagtctgggggaggcttagtggagcctggagggtccctgaaactctcctgtgtagcctctggattcgctttcagt

SEQ ID NO: 1433 - protein, 30 aa, Artificial Sequence
  Mouse B2 heavy chain variable framework 1 (FW1) sequence
EVVLVESGGGLVEPGGSLKLSCVASGFAFS

SEQ ID NO: 1434 - DNA, 15 bp, Artificial Sequence
  Mouse B2 heavy chain variable complementarity determining regions 1 (CDR1) sequence
acctttgccatgtct

SEQ ID NO: 1435 - protein, 5 aa, Artificial Sequence
  Mouse B2 heavy chain variable complementarity determining regions 1 (CDR1) sequence
TFAMS

SEQ ID NO: 1436 - DNA, 42 bp, Artificial Sequence
  Mouse B2 heavy chain variable framework 2 (FW2) sequence
tggattcgccagactccggagaagaggctggagtgggtcgca

SEQ ID NO: 1437 - protein, 14 aa, Artificial Sequence
  Mouse B2 heavy chain variable framework 2 (FW2) sequence
WIRQTPEKRLEWVA

SEQ ID NO: 1438 - DNA, 51 bp, Artificial Sequence
  Mouse B2 heavy chain variable complementarity determining regions 2 (CDR2) sequence
gccattagtaatggtggtggttacacctactatccagacactctgaagggg

SEQ ID NO: 1439 - protein, 17 aa, Artificial Sequence
  Mouse B2 heavy chain variable complementarity determining regions 2 (CDR2) sequence
AISNGGGYTYYPDTLKG

SEQ ID NO: 1440 - DNA, 96 bp, Artificial Sequence
  Mouse B2 heavy chain variable framework 3 (FW3) sequence
cgattctccatctccagagacaatgccaagaataccctgtacctgcaaatgagtagtctgaggtctgaggacacggccgtgtattactgtgcaaga

SEQ ID NO: 1441 - protein, 32 aa, Artificial Sequence
  Mouse B2 heavy chain variable framework 3 (FW3) sequence
RFSISRDNAKNTLYLQMSSLRSEDTAVYYCAR

SEQ ID NO: 1442 - DNA, 27 bp, Artificial Sequence
  Mouse B2 heavy chain variable complementarity determining regions 3 (CDR3) sequence
cgctactatgatctctactttgactta

SEQ ID NO: 1443 - protein, 9 aa, Artificial Sequence
  Mouse B2 heavy chain variable complementarity determining regions 3 (CDR3) sequence
RYYDLYFDL

SEQ ID NO: 1444 - DNA, 33 bp, Artificial Sequence
  Mouse B2 heavy chain variable framework 4 (FW4) sequence
tggggccgaggcacctctctcatagtctcctca

SEQ ID NO: 1445 - protein, 11 aa, Artificial Sequence
  Mouse B2 heavy chain variable framework 4 (FW4) sequence
WGRGTSLIVSS

SEQ ID NO: 1446 - DNA, 69 bp, Artificial Sequence
  Mouse B2 light chain variable framework 1 (FR1) sequence
gatattctgatgacccaaactccactctccctgcctgtcagtcttggagatcaagcctccatttcttgc

SEQ ID NO: 1447 - protein, 23 aa, Artificial Sequence
  Mouse B2 light chain variable framework 1 (FR1) sequence
DILMTQTPLSLPVSLGDQASISC

SEQ ID NO: 1448 - DNA, 48 bp, Artificial Sequence
  Mouse B2 light chain variable complementarity determining regions 1 (CDR1) sequence
agatctagtcagaacattgtacatagtaatggaaacacctatttagaa

SEQ ID NO: 1449 - protein, 16 aa, Artificial Sequence
  Mouse B2 light chain variable complementarity determining regions 1 (CDR1) sequence
RSSQNIVHSNGNTYLE

SEQ ID NO: 1450 - DNA, 45 bp, Artificial Sequence; identical to SEQ ID NO: 464
  Mouse B2 light chain variable framework 2 (FR2) sequence

SEQ ID NO: 1451 - protein, 15 aa, Artificial Sequence
  Mouse B2 light chain variable framework 2 (FR2) sequence
WYLQKPGQSPKLLIY

SEQ ID NO: 1452 - DNA, 21 bp, Artificial Sequence
  Mouse B2 light chain variable complementarity determining regions 2 (CDR2) sequence
aaagtttccaaccgattttct

SEQ ID NO: 1453 - protein, 7 aa, Artificial Sequence
  Mouse B2 light chain variable complementarity determining regions 2 (CDR2) sequence
KVSNRFS

SEQ ID NO: 1454 - DNA, 96 bp, Artificial Sequence
  Mouse B2 light chain variable framework 3 (FR3) sequence
ggggtccccgacaggttcagtggtagtgggtcagggacagatttcacactcaagatcagcagagtggaggctgaggatctgggagtttattactgc

SEQ ID NO: 1455 - protein, 32 aa, Artificial Sequence; identical to SEQ ID NO: 887
  Mouse B2 light chain variable framework 3 (FR3) sequence

SEQ ID NO: 1456 - DNA, 27 bp, Artificial Sequence
  Mouse B2 light chain variable complementarity determining regions 3 (CDR3) sequence
tttcaagattcacatgttcctctcacg

SEQ ID NO: 1457 - protein, 9 aa, Artificial Sequence
  Mouse B2 light chain variable complementarity determining regions 3 (CDR3) sequence
FQDSHVPLT

SEQ ID NO: 1458 - DNA, 30 bp, Artificial Sequence
  Mouse B2 light chain variable framework 4 (FR4) sequence
ttcggtgctgggaccaggctggagctgaaa

SEQ ID NO: 1459 - protein, 10 aa, Artificial Sequence
  Mouse B2 light chain variable framework 4 (FR4) sequence
FGAGTRLELK

SEQ ID NO: 1460 - DNA, 90 bp, Artificial Sequence
  Mouse B7 heavy chain variable framework 1 (FW1) sequence
gaggtgcaggtggtggagtctgggggagacttagtgaagcctggagggtccctgaaactctcctgtgcagcctctggattcactttcagt

SEQ ID NO: 1461 - protein, 30 aa, Artificial Sequence
  Mouse B7 heavy chain variable framework 1 (FW1) sequence
EVQVVESGGDLVKPGGSLKLSCAASGFTFS

SEQ ID NO: 1462 - DNA, 15 bp, Artificial Sequence
  Mouse B7 heavy chain variable complementarity determining regions 1 (CDR1) sequence
agatatggcatgtct

SEQ ID NO: 1463 - protein, 5 aa, Artificial Sequence
  Mouse B7 heavy chain variable complementarity determining regions 1 (CDR1) sequence
RYGMS

SEQ ID NO: 1464 - DNA, 42 bp, Artificial Sequence; identical to SEQ ID NO: 1026
  Mouse B7 heavy chain variable framework 2 (FW2) sequence

SEQ ID NO: 1465 - protein, 14 aa, Artificial Sequence
  Mouse B7 heavy chain variable framework 2 (FW2) sequence
WVRQTPDKRLEWVA

SEQ ID NO: 1466 - DNA, 51 bp, Artificial Sequence
  Mouse B7 heavy chain variable complementarity determining regions 2 (CDR2) sequence
accattagtagtggtggtacttacatctactatccagacagtgtgaagggg

SEQ ID NO: 1467 - protein, 17 aa, Artificial Sequence
  Mouse B7 heavy chain variable complementarity determining regions 2 (CDR2) sequence
TISSGGTYIYYPDSVKG

SEQ ID NO: 1468 - DNA, 96 bp, Artificial Sequence
  Mouse B7 heavy chain variable framework 3 (FW3) sequence
cgattcaccatctccagagacaatgccaagaacaccctgtacctgcaaatgagcagtctgaagtctgaggacacagccatgtattactgtgcaagg

SEQ ID NO: 1469 - protein, 32 aa, Artificial Sequence
  Mouse B7 heavy chain variable framework 3 (FW3) sequence
RFTISRDNAKNTLYLQMSSLKSEDTAMYYCAR

SEQ ID NO: 1470 - DNA, 39 bp, Artificial Sequence
  Mouse B7 heavy chain variable complementarity determining regions 3 (CDR3) sequence
gataactacggtagtagctacgactatgctatggactac

SEQ ID NO: 1471 - protein, 13 aa, Artificial Sequence
  Mouse B7 heavy chain variable complementarity determining regions 3 (CDR3) sequence
DNYGSSYDYAMDY

SEQ ID NO: 1472 - DNA, 33 bp, Artificial Sequence; identical to SEQ ID NO: 1210
  Mouse B7 heavy chain variable framework 4 (FW4) sequence

SEQ ID NO: 1473 - protein, 11 aa, Artificial Sequence
  Mouse B7 heavy chain variable framework 4 (FW4) sequence
WGQGTSVTVSS

SEQ ID NO: 1474 - DNA, 69 bp, Artificial Sequence; identical to SEQ ID NO: 460
  Mouse B7 light chain variable framework 1 (FR1) sequence

SEQ ID NO: 1475 - protein, 23 aa, Artificial Sequence
  Mouse B7 light chain variable framework 1 (FR1) sequence
DVLMTQTPLSLPVSLGDQASISC

SEQ ID NO: 1476 - DNA, 48 bp, Artificial Sequence; identical to SEQ ID NO: 462
  Mouse B7 light chain variable complementarity determining regions 1 (CDR1) sequence

SEQ ID NO: 1477 - protein, 16 aa, Artificial Sequence
  Mouse B7 light chain variable complementarity determining regions 1 (CDR1) sequence
RSSQTIVHSNGNTYLE

SEQ ID NO: 1478 - DNA, 45 bp, Artificial Sequence
  Mouse B7 light chain variable framework 2 (FR2) sequence
tggtacctgcaaaaaccaggccagtctccaaagctcctgatctac

SEQ ID NO: 1479 - protein, 15 aa, Artificial Sequence
  Mouse B7 light chain variable framework 2 (FR2) sequence
WYLQKPGQSPKLLIY

SEQ ID NO: 1480 - DNA, 21 bp, Artificial Sequence
  Mouse B7 light chain variable complementarity determining regions 2 (CDR2) sequence
aaagtttccaaccgattttct

SEQ ID NO: 1481 - protein, 7 aa, Artificial Sequence
  Mouse B7 light chain variable complementarity determining regions 2 (CDR2) sequence
KVSNRFS

SEQ ID NO: 1482 - DNA, 96 bp, Artificial Sequence; identical to SEQ ID NO: 1378
  Mouse B7 light chain variable framework 3 (FR3) sequence

SEQ ID NO: 1483 - protein, 32 aa, Artificial Sequence; identical to SEQ ID NO: 887
  Mouse B7 light chain variable framework 3 (FR3) sequence

SEQ ID NO: 1484 - DNA, 27 bp, Artificial Sequence
  Mouse B7 light chain variable complementarity determining regions 3 (CDR3) sequence
tttcaagattcacatgttcctctcacg

SEQ ID NO: 1485 - protein, 9 aa, Artificial Sequence
  Mouse B7 light chain variable complementarity determining regions 3 (CDR3) sequence
FQDSHVPLT

SEQ ID NO: 1486 - DNA, 30 bp, Artificial Sequence; identical to SEQ ID NO: 1018
  Mouse B7 light chain variable framework 4 (FR4) sequence

SEQ ID NO: 1487 - protein, 10 aa, Artificial Sequence
  Mouse B7 light chain variable framework 4 (FR4) sequence
FGAGTKLELK

SEQ ID NO: 1488 - DNA, 90 bp, Artificial Sequence; identical to SEQ ID NO: 990
  Mouse 8C7F3 heavy chain variable framework 1 (FW1) sequence

SEQ ID NO: 1489 - protein, 30 aa, Artificial Sequence; identical to SEQ ID NO: 991
  Mouse 8C7F3 heavy chain variable framework 1 (FW1) sequence

SEQ ID NO: 1490 - DNA, 15 bp, Artificial Sequence
  Mouse 8C7F3 heavy chain variable complementarity determining regions 1 (CDR1) sequence
acctatgccatgtct

SEQ ID NO: 1491 - protein, 5 aa, Artificial Sequence
  Mouse 8C7F3 heavy chain variable complementarity determining regions 1 (CDR1) sequence
TYAMS

SEQ ID NO: 1492 - DNA, 42 bp, Artificial Sequence; identical to SEQ ID NO: 124
  Mouse 8C7F3 heavy chain variable framework 2 (FW2) sequence

SEQ ID NO: 1493 - protein, 14 aa, Artificial Sequence
  Mouse 8C7F3 heavy chain variable framework 2 (FW2) sequence
WVRQTPEKRLEWVA

SEQ ID NO: 1494 - DNA, 51 bp, Artificial Sequence; identical to SEQ ID NO: 1362
  Mouse 8C7F3 heavy chain variable complementarity determining regions 2 (CDR2) sequence

SEQ ID NO: 1495 - protein, 17 aa, Artificial Sequence
  Mouse 8C7F3 heavy chain variable complementarity determining regions 2 (CDR2) sequence
AISNGGGYTYYPDSLKG

SEQ ID NO: 1496 - DNA, 96 bp, Artificial Sequence; identical to SEQ ID NO: 1364
  Mouse 8C7F3 heavy chain variable framework 3 (FW3) sequence

SEQ ID NO: 1497 - protein, 32 aa, Artificial Sequence; identical to SEQ ID NO: 1365
  Mouse 8C7F3 heavy chain variable framework 3 (FW3) sequence

SEQ ID NO: 1498 - DNA, 27 bp, Artificial Sequence
  Mouse 8C7F3 heavy chain variable complementarity determining regions 3 (CDR3) sequence
cgttactatgatcactactttgactac

SEQ ID NO: 1499 - protein, 9 aa, Artificial Sequence
  Mouse 8C7F3 heavy chain variable complementarity determining regions 3 (CDR3) sequence
RYYDHYFDY

SEQ ID NO: 1500 - DNA, 33 bp, Artificial Sequence; identical to SEQ ID NO: 1368
  Mouse 8C7F3 heavy chain variable framework 4 (FW4) sequence

SEQ ID NO: 1501 - protein, 11 aa, Artificial Sequence
  Mouse 8C7F3 heavy chain variable framework 4 (FW4) sequence
WGQGTALTVSS

SEQ ID NO: 1502 - DNA, 69 bp, Artificial Sequence; identical to SEQ ID NO: 1428
  Mouse 8C7F3 light chain variable framework 1 (FR1) sequence

SEQ ID NO: 1503 - protein, 23 aa, Artificial Sequence
  Mouse 8C7F3 light chain variable framework 1 (FR1) sequence
IIVLTQSPASLAVSLGQRATISC

SEQ ID NO: 1504 - DNA, 45 bp, Artificial Sequence; identical to SEQ ID NO: 1430
  Mouse 8C7F3 light chain variable complementarity determining regions 1 (CDR1) sequence

SEQ ID NO: 1505 - protein, 15 aa, Artificial Sequence
  Mouse 8C7F3 light chain variable complementarity determining regions 1 (CDR1) sequence
RASESVATYGNNFMQ

SEQ ID NO: 1506 - DNA, 45 bp, Artificial Sequence
  Mouse 8C7F3 light chain variable framework 2 (FR2) sequence
tggtatcagcagaaaccaggacagccacccaaactcctcatctat

SEQ ID NO: 1507 - protein, 15 aa, Artificial Sequence
  Mouse 8C7F3 light chain variable framework 2 (FR2) sequence
WYQQKPGQPPKLLIY

SEQ ID NO: 1508 - DNA, 21 bp, Artificial Sequence
  Mouse 8C7F3 light chain variable complementarity determining regions 2 (CDR2) sequence
cttgcatccaccctagattct

SEQ ID NO: 1509 - protein, 7 aa, Artificial Sequence
  Mouse 8C7F3 light chain variable complementarity determining regions 2 (CDR2) sequence
LASTLDS

SEQ ID NO: 1510 - DNA, 96 bp, Artificial Sequence
  Mouse 8C7F3 light chain variable framework 3 (FR3) sequence
ggggtccctgccaggttcagtggcagtgggtctaggacagacttcaccctcaccattgatcctgtggaggctgatgatgctgcaacctattactgt

SEQ ID NO: 1511 - protein, 32 aa, Artificial Sequence
  Mouse 8C7F3 light chain variable framework 3 (FR3) sequence
GVPARFSGSGSRTDFTLTIDPVEADDAATYYC

SEQ ID NO: 1512 - DNA, 27 bp, Artificial Sequence
  Mouse 8C7F3 light chain variable complementarity determining regions 3 (CDR3) sequence
cagcaaaataatgaggatcctccgacg

SEQ ID NO: 1513 - protein, 9 aa, Artificial Sequence
  Mouse 8C7F3 light chain variable complementarity determining regions 3 (CDR3) sequence
QQNNEDPPT

SEQ ID NO: 1514 - DNA, 30 bp, Artificial Sequence
  Mouse 8C7F3 light chain variable framework 4 (FR4) sequence
ttcggtggaggcaccaagctggaaatcaag

SEQ ID NO: 1515 - protein, 10 aa, Artificial Sequence
  Mouse 8C7F3 light chain variable framework 4 (FR4) sequence
FGGGTKLEIK

SEQ ID NO: 1516 - DNA, 90 bp, Artificial Sequence
  Mouse H11 heavy chain variable framework 1 (FW1) sequence
gaagtggtgctggtggagtctgggggaggcttagtggagcctggagggtccctgaaactctcctgtgtagcctctggattcgcttttagt

SEQ ID NO: 1517 - protein, 30 aa, Artificial Sequence; identical to SEQ ID NO: 1433
  Mouse H11 heavy chain variable framework 1 (FW1) sequence

SEQ ID NO: 1518 - DNA, 15 bp, Artificial Sequence
  Mouse H11 heavy chain variable complementarity determining regions 1 (CDR1) sequence
acctttgccatgtct

SEQ ID NO: 1519 - protein, 5 aa, Artificial Sequence
  Mouse H11 heavy chain variable complementarity determining regions 1 (CDR1) sequence
TFAMS

SEQ ID NO: 1520 - DNA, 42 bp, Artificial Sequence; identical to SEQ ID NO: 1436
  Mouse H11 heavy chain variable framework 2 (FW2) sequence

SEQ ID NO: 1521 - protein, 14 aa, Artificial Sequence
  Mouse H11 heavy chain variable framework 2 (FW2) sequence
WIRQTPEKRLEWVA

SEQ ID NO: 1522 - DNA, 51 bp, Artificial Sequence
  Mouse H11 heavy chain variable complementarity determining regions 2 (CDR2) sequence
gccattagtaatggtggtggttacacttactatccagacactctgaagggg

SEQ ID NO: 1523 - protein, 17 aa, Artificial Sequence
  Mouse H11 heavy chain variable complementarity determining regions 2 (CDR2) sequence
AISNGGGYTYYPDTLKG

SEQ ID NO: 1524 - DNA, 96 bp, Artificial Sequence
  Mouse H11 heavy chain variable framework 3 (FW3) sequence
cgattcaccatctccagagacaatgccaagaataccctgtacctgcaaatgagtagtctgaggtctgaggacacggccgtgtattactgtgcaaga

SEQ ID NO: 1525 - protein, 32 aa, Artificial Sequence
  Mouse H11 heavy chain variable framework 3 (FW3) sequence
RFTISRDNAKNTLYLQMSSLRSEDTAVYYCAR

SEQ ID NO: 1526 - DNA, 27 bp, Artificial Sequence
  Mouse H11 heavy chain variable complementarity determining regions 3 (CDR3) sequence
cgctactatgatctctactttgactta

SEQ ID NO: 1527 - protein, 9 aa, Artificial Sequence
  Mouse H11 heavy chain variable complementarity determining regions 3 (CDR3) sequence
RYYDLYFDL

SEQ ID NO: 1528 - DNA, 33 bp, Artificial Sequence
  Mouse H11 heavy chain variable framework 4 (FW4) sequence
tggggccaaggcacctctctcatagtctcctca

SEQ ID NO: 1529 - protein, 11 aa, Artificial Sequence
  Mouse H11 heavy chain variable framework 4 (FW4) sequence
WGQGTSLIVSS

SEQ ID NO: 1530 - DNA, 69 bp, Artificial Sequence; identical to SEQ ID NO: 1446
  Mouse H11 light chain variable framework 1 (FR1) sequence

SEQ ID NO: 1531 - protein, 23 aa, Artificial Sequence
  Mouse H11 light chain variable framework 1 (FR1) sequence
DILMTQTPLSLPVSLGDQASISC

SEQ ID NO: 1532 - DNA, 48 bp, Artificial Sequence; identical to SEQ ID NO: 1448
  Mouse H11 light chain variable complementarity determining regions 1 (CDR1) sequence

SEQ ID NO: 1533 - protein, 16 aa, Artificial Sequence
  Mouse H11 light chain variable complementarity determining regions 1 (CDR1) sequence
RSSQNIVHSNGNTYLE

SEQ ID NO: 1534 - DNA, 45 bp, Artificial Sequence; identical to SEQ ID NO: 464
  Mouse H11 light chain variable framework 2 (FR2) sequence

SEQ ID NO: 1535 - protein, 15 aa, Artificial Sequence
  Mouse H11 light chain variable framework 2 (FR2) sequence
WYLQKPGQSPKLLIY

SEQ ID NO: 1536 - DNA, 21 bp, Artificial Sequence
  Mouse H11 light chain variable complementarity determining regions 2 (CDR2) sequence
aaagtttccaaccgattttct

SEQ ID NO: 1537 - protein, 7 aa, Artificial Sequence
  Mouse H11 light chain variable complementarity determining regions 2 (CDR2) sequence
KVSNRFS

SEQ ID NO: 1538 - DNA, 96 bp, Artificial Sequence; identical to SEQ ID NO: 1454
  Mouse H11 light chain variable framework 3 (FR3) sequence

SEQ ID NO: 1539 - protein, 32 aa, Artificial Sequence; identical to SEQ ID NO: 887
  Mouse H11 light chain variable framework 3 (FR3) sequence

SEQ ID NO: 1540 - DNA, 27 bp, Artificial Sequence
  Mouse H11 light chain variable complementarity determining regions 3 (CDR3) sequence
tttcaagattcacatgttcctctcacg

SEQ ID NO: 1541 - protein, 9 aa, Artificial Sequence
  Mouse H11 light chain variable complementarity determining regions 3 (CDR3) sequence
FQDSHVPLT

SEQ ID NO: 1542 - DNA, 30 bp, Artificial Sequence; identical to SEQ ID NO: 1458
  Mouse H11 light chain variable framework 4 (FR4) sequence

SEQ ID NO: 1543 - protein, 10 aa, Artificial Sequence
  Mouse H11 light chain variable framework 4 (FR4) sequence
FGAGTRLELK

SEQ ID NO: 1544 - DNA, 90 bp, Artificial Sequence; identical to SEQ ID NO: 1460
  Mouse B9 heavy chain variable framework 1 (FW1) sequence

SEQ ID NO: 1545 - protein, 30 aa, Artificial Sequence; identical to SEQ ID NO: 1461
  Mouse B9 heavy chain variable framework 1 (FW1) sequence

SEQ ID NO: 1546 - DNA, 15 bp, Artificial Sequence
  Mouse B9 heavy chain variable complementarity determining regions 1 (CDR1) sequence
agatatggcatgtct

SEQ ID NO: 1547 - protein, 5 aa, Artificial Sequence
  Mouse B9 heavy chain variable complementarity determining regions 1 (CDR1) sequence
RYGMS

SEQ ID NO: 1548 - DNA, 42 bp, Artificial Sequence; identical to SEQ ID NO: 1026
  Mouse B9 heavy chain variable framework 2 (FW2) sequence

SEQ ID NO: 1549 - protein, 14 aa, Artificial Sequence
  Mouse B9 heavy chain variable framework 2 (FW2) sequence
WVRQTPDKRLEWVA

SEQ ID NO: 1550 - DNA, 51 bp, Artificial Sequence; identical to SEQ ID NO: 1466
  Mouse B9 heavy chain variable complementarity determining regions 2 (CDR2) sequence

SEQ ID NO: 1551 - protein, 17 aa, Artificial Sequence
  Mouse B9 heavy chain variable complementarity determining regions 2 (CDR2) sequence
TISSGGTYIYYPDSVKG

SEQ ID NO: 1552 - DNA, 93 bp, Artificial Sequence
  Mouse B9 heavy chain variable framework 3 (FW3) sequence
cgattcaccatctccagagacaatgccaagaacaccctgtacctgcaaatgagcagtctgaagtctgaggacacagccatgtattactgtgca

SEQ ID NO: 1553 - protein, 32 aa, Artificial Sequence; identical to SEQ ID NO: 1469
  Mouse B9 heavy chain variable framework 3 (FW3) sequence

SEQ ID NO: 1554 - DNA, 42 bp, Artificial Sequence
  Mouse B9 heavy chain variable complementarity determining regions 3 (CDR3) sequence
agggataactacggtagtagctacgactatgctatggactac

SEQ ID NO: 1555 - protein, 13 aa, Artificial Sequence
  Mouse B9 heavy chain variable complementarity determining regions 3 (CDR3) sequence
DNYGSSYDYAMDY

SEQ ID NO: 1556 - DNA, 33 bp, Artificial Sequence
  Mouse B9 heavy chain variable framework 4 (FW4) sequence
tggggtcaaggaacctcagtcaccgtctcctct

SEQ ID NO: 1557 - protein, 11 aa, Artificial Sequence
  Mouse B9 heavy chain variable framework 4 (FW4) sequence
WGQGTSVTVSS

SEQ ID NO: 1558 - DNA, 69 bp, Artificial Sequence; identical to SEQ ID NO: 67
  Mouse B9 light chain variable framework 1 (FR1) sequence

SEQ ID NO: 1559 - protein, 23 aa, Artificial Sequence
  Mouse B9 light chain variable framework 1 (FR1) sequence
QIVLTQSPAIMSASPGEEVTLTC

SEQ ID NO: 1560 - DNA, 30 bp, Artificial Sequence
  Mouse B9 light chain variable complementarity determining regions 1 (CDR1) sequence
agtgccagctcaagtgtaagttacatgcac

SEQ ID NO: 1561 - protein, 10 aa, Artificial Sequence
  Mouse B9 light chain variable complementarity determining regions 1 (CDR1) sequence
SASSSVSYMH

SEQ ID NO: 1562 - DNA, 45 bp, Artificial Sequence; identical to SEQ ID NO: 71
  Mouse B9 light chain variable framework 2 (FR2) sequence

SEQ ID NO: 1563 - protein, 15 aa, Artificial Sequence
  Mouse B9 light chain variable framework 2 (FR2) sequence
WFQQRPGTSPKLWIY

SEQ ID NO: 1564 - DNA, 21 bp, Artificial Sequence
  Mouse B9 light chain variable complementarity determining regions 2 (CDR2) sequence
accacatccaacctggcttct

SEQ ID NO: 1565 - protein, 7 aa, Artificial Sequence
  Mouse B9 light chain variable complementarity determining regions 2 (CDR2) sequence
TTSNLAS

SEQ ID NO: 1566 - DNA, 96 bp, Artificial Sequence
  Mouse B9 light chain variable framework 3 (FR3) sequence
ggagtccctgctcgcttcagtggcagtggatctgggacctcttactctctcacaatcagccgaatggaggctgaagatgctgccacttattactgc

SEQ ID NO: 1567 - protein, 32 aa, Artificial Sequence
  Mouse B9 light chain variable framework 3 (FR3) sequence
GVPARFSGSGSGTSYSLTISRMEAEDAATYYC

SEQ ID NO: 1568 - DNA, 24 bp, Artificial Sequence
  Mouse B9 light chain variable complementarity determining regions 3 (CDR3) sequence
cagcaaaggagtagttacccattc

SEQ ID NO: 1569 - protein, 8 aa, Artificial Sequence
  Mouse B9 light chain variable complementarity determining regions 3 (CDR3) sequence
QQRSSYPF

SEQ ID NO: 1570 - DNA, 33 bp, Artificial Sequence
  Mouse B9 light chain variable framework 4 (FR4) sequence
acgttcggctcggggacaaagttggaaataaaa

SEQ ID NO: 1571 - protein, 11 aa, Artificial Sequence
  Mouse B9 light chain variable framework 4 (FR4) sequence
TFGSGTKLEIK

SEQ ID NO: 1572 - DNA, 741 bp, Artificial Sequence
  mu3C2B1 scFv sequence
gaagtgatgctggtggagtctgggggaggcttagtgaagcctggagggtccctgaaactctcctgtgcagcctctggaatcactttcagtacctataccatgtcgtgggttcgccagactccggagaagaggctggagtgggtcgcaaccattagtactggtggtgataaaacctactattcagacagtgtgaagggtcgattcaccatctccagagacaatgccaagaacaacctgtacctccaaatgagcagtctgaggtctgaggacacggccttgtattactgtgcaaggggaaccacggctatgtattactatgctatggactactggggtcaaggaacctcagtcaccgtctcctcaggtggcggaggatctggcggaggtggaagcggcggaggcggatccgacattgtgctgacacagtctcctgcttccttagctgtatctctggggcagagggccaccatctcatgcagggccagcaaaagtatcagtacatctgactataattatattcactggtaccaacagaaaccaggacagccacccaaactcctcatctatcttgcatccaacctagaatctggggtccctgccaggttcagtggcagtgggtctgggacagacttcaccctcaacatccatcctgtggaggaagaagatgctgcaacctattactgtcagcacagtagggagcttcctctcacgttcggtgctgggaccaagctggagctgaaa

SEQ ID NO: 1573 - protein, 247 aa, Artificial Sequence
  mu3C2B1 scFv sequence
EVMLVESGGGLVKPGGSLKLSCAASGITFSTYTMSWVRQTPEKRLEWVATISTGGDKTYYSDSVKGRFTISRDNAKNNLYLQMSSLRSEDTALYYCARGTTAMYYYAMDYWGQGTSVTVSSGGGGSGGGGSGGGGSDIVLTQSPASLAVSLGQRATISCRASKSISTSDYNYIHWYQQKPGQPPKLLIYLASNLESGVPARFSGSGSGTDFTLNIHPVEEEDAATYYCQHSRELPLTFGAGTKLELK

SEQ ID NO: 1574 - DNA, 741 bp, Artificial Sequence
  mu20A10 scFv full sequence
gaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagccccagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaag

SEQ ID NO: 1575 - protein, 247 aa, Artificial Sequence
  mu20A10 scFv full sequence
EVMLVESGGGLVKPGGSLKLSCAASGFTFSTYAMSWIRQTPEKRLEWVASIGRAGSTYYSDSVKGRFTISRDNVRNILYLQMSSLRSEDTAMYYCARGPIYNDYDEFAYWGQGTLVTVSAGGGGSGGGGSGGGGSNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELK

SEQ ID NO: 1576 - DNA, 741 bp, Artificial Sequence
  hu20A10M scFV
gaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacatcgtgatgacacagagcccttctagcctggccgtgtctctgggagagagagccacaatcagctgcaagagcagccagagcgtgctgtactccagcaaccagaagaactacctggcctggtatcagcagaagcccggacagtctcccaagctgctgatctactgggccagcaccagagaaagcggcgtgcccgatagattcacaggctctggcagcggcaccgacttcaccctgacaattagcagtctgcaggccgaggacgtggccgtgtactactgtcaccagtacctgagcagcctgacctttggcggcggaacaaaggtggaaatcaag

SEQ ID NO: 1577 - protein, 247 aa, Artificial Sequence
  hu20A10M scFV
EVQLVESGGGLVKPGGSLRLSCAASGFTFSTYAMSWVRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSDIVMTQSPSSLAVSLGERATISCKSSQSVLYSSNQKNYLAWYQQKPGQSPKLLIYWASTRESGVPDRFTGSGSGTDFTLTISSLQAEDVAVYYCHQYLSSLTFGGGTKVEIK

SEQ ID NO: 1578 - DNA, 744 bp, Artificial Sequence
  hu20A10C2 scFV
gaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacga

SEQ ID NO: 1579 - protein, 248 aa, Artificial Sequence
  hu20A10C2 scFV
EVQLVESGGGLVKPGGSLRLSCAASGFTFSTYAMSWVRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSDIVLTQSPASLAVSPGQRATITCKSSQSVLYSSNQKNYLAWYQQKPGQPPKLLIYWASTRESGVPARFSGSGSGTDFTLTINPVEANDTANYYCHQYLSSLTFGGGTKVEIKR

SEQ ID NO: 1580 - DNA, 744 bp, Artificial Sequence
  hu20A10N scFV
caggtgcagctggttgaatctggcggcggacttgtgaagcctggcggatctctgagactgagctgtgccgccagcggcttcacctttagcacatacgccatgagctggatcagacaggcccctggcaaaggcctggaatgggtggcgtctattggcagagccggcagcacctactacagcgactctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtttctagcggcggtggcggaagcggaggcggtggctccggtggcggaggcagcgaaattgtgctgacacagagccccgccacactgtcactttctccaggcgaaagagccacactgagctgcaagagcagccagagcgtgctgtactccagcaaccagaagaactacctggcctggtatcagcagaagcccggccaagctcctcggctgctgatctattgggccagcacaagagagagcggcatccctgccagattttctggcagcggctctggcaccgatttcaccctgaccataagcagcctggaacctgaggacttcgccgtgtattactgccaccagtacctgagcagcctgacctttggcggaggcaccaaggtggaaatcaagcgg

SEQ ID NO: 1581 - protein, 248 aa, Artificial Sequence
  hu20A10N scFV
QVQLVESGGGLVKPGGSLRLSCAASGFTFSTYAMSWIRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSEIVLTQSPATLSLSPGERATLSCKSSQSVLYSSNQKNYLAWYQQKPGQAPRLLIYWASTRESGIPARFSGSGSGTDFTLTISSLEPEDFAVYYCHQYLSSLTFGGGTKVEIKR

SEQ ID NO: 1582 - DNA, 1479 bp, Artificial Sequence
  mu20A10CAR T841BB3z
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1583 - protein, 491 aa, Artificial Sequence
  mu20A10CAR T841BB3z
MALPVTALLLPLALLLHAARPEVMLVESGGGLVKPGGSLKLSCAASGFTFSTYAMSWIRQTPEKRLEWVASIGRAGSTYYSDSVKGRFTISRDNVRNILYLQMSSLRSEDTAMYYCARGPIYNDYDEFAYWGQGTLVTVSAGGGGSGGGGSGGGGSNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1584 - DNA, 1482 bp, Artificial Sequence
  hu20A10CAR T841BB3z
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1585 - protein, 492 aa, Artificial Sequence
  hu20A10CAR T841BB3z
MALPVTALLLPLALLLHAARPEVQLVESGGGLVKPGGSLRLSCAASGFTFSTYAMSWVRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSDIVLTQSPASLAVSPGQRATITCKSSQSVLYSSNQKNYLAWYQQKPGQPPKLLIYWASTRESGVPARFSGSGSGTDFTLTINPVEANDTANYYCHQYLSSLTFGGGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1586 - DNA, 1476 bp, Artificial Sequence
  mu20A10CAR T8283z
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1587 - protein, 490 aa, Artificial Sequence
  mu20A10CAR T8283z
MALPVTALLLPLALLLHAARPEVMLVESGGGLVKPGGSLKLSCAASGFTFSTYAMSWIRQTPEKRLEWVASIGRAGSTYYSDSVKGRFTISRDNVRNILYLQMSSLRSEDTAMYYCARGPIYNDYDEFAYWGQGTLVTVSAGGGGSGGGGSGGGGSNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1588 - DNA, 1479 bp, Artificial Sequence
  hu20A10CAR T8283z
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1589 - protein, 491 aa, Artificial Sequence
  hu20A10CAR T8283z
MALPVTALLLPLALLLHAARPEVQLVESGGGLVKPGGSLRLSCAASGFTFSTYAMSWVRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSDIVLTQSPASLAVSPGQRATITCKSSQSVLYSSNQKNYLAWYQQKPGQPPKLLIYWASTRESGVPARFSGSGSGTDFTLTINPVEANDTANYYCHQYLSSLTFGGGTKVEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1590 - DNA, 1479 bp, Artificial Sequence
  mu20A10CAR T841BB3z1XX
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1591 - protein, 491 aa, Artificial Sequence
  mu20A10CAR T841BB3z1XX
MALPVTALLLPLALLLHAARPEVMLVESGGGLVKPGGSLKLSCAASGFTFSTYAMSWIRQTPEKRLEWVASIGRAGSTYYSDSVKGRFTISRDNVRNILYLQMSSLRSEDTAMYYCARGPIYNDYDEFAYWGQGTLVTVSAGGGGSGGGGSGGGGSNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1592 - DNA, 1482 bp, Artificial Sequence
  hu20A10CAR T841BB3z1XX
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1593 - protein, 492 aa, Artificial Sequence
  hu20A10CAR T841BB3z1XX
MALPVTALLLPLALLLHAARPEVQLVESGGGLVKPGGSLRLSCAASGFTFSTYAMSWVRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSDIVLTQSPASLAVSPGQRATITCKSSQSVLYSSNQKNYLAWYQQKPGQPPKLLIYWASTRESGVPARFSGSGSGTDFTLTINPVEANDTANYYCHQYLSSLTFGGGTKVEIKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1594 - DNA, 1476 bp, Artificial Sequence
  mu20A10CAR T8283z1XX
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1595 - protein, 490 aa, Artificial Sequence
  mu20A10CAR T8283z1XX
MALPVTALLLPLALLLHAARPEVMLVESGGGLVKPGGSLKLSCAASGFTFSTYAMSWIRQTPEKRLEWVASIGRAGSTYYSDSVKGRFTISRDNVRNILYLQMSSLRSEDTAMYYCARGPIYNDYDEFAYWGQGTLVTVSAGGGGSGGGGSGGGGSNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSLTFGAGTKLELKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1596 - DNA, 1479 bp, Artificial Sequence
  hu20A10CAR T8283z1XX
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1597 - protein, 491 aa, Artificial Sequence
  hu20A10CAR T8283z1XX
MALPVTALLLPLALLLHAARPEVQLVESGGGLVKPGGSLRLSCAASGFTFSTYAMSWVRQAPGKGLEWVASIGRAGSTYYSDSVKGRFTISRDNAKNSLYLQMNSLRAEDTAVYYCARGPIYNDYDEFAYWGQGTLVTVSSGGGGSGGGGSGGGGSDIVLTQSPASLAVSPGQRATITCKSSQSVLYSSNQKNYLAWYQQKPGQPPKLLIYWASTRESGVPARFSGSGSGTDFTLTINPVEANDTANYYCHQYLSSLTFGGGTKVEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1598 - DNA, 738 bp, Artificial Sequence
  mu25E6 scFv full sequence
gaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaa

SEQ ID NO: 1599 - protein, 246 aa, Artificial Sequence
  mu25E6 scFv full sequence
EVQLVESGGDLVKPGGSLKLSCAASGFTFSSYGMSWVRQTPDKRLEWVATISNGGRHTFYPDSVKGRFTISRDNAKNTLYLQMSSLKSEDTAMYLCVRQTGTEGWFAYWGQGTLVTVSAGGGGSGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIK

SEQ ID NO: 1600 - DNA, 738 bp, Artificial Sequence
  hu25E6 full sequence
gaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaag

SEQ ID NO: 1601 - protein, 246 aa, Artificial Sequence
  hu25E6 full sequence
EVQLVESGGGLVKPGGSLRLSCAASGFTFSSYGMSWVRQAPGKGLEWVSTISNGGRHTFYPDSVKGRFTISRDNAKNSLYLQMNSLRAEDTAVYYCARQTGTEGWFAYWGQGTLVTVSSGGGGSGGGGSGGGGSDIVMTQTPLSLSVTPGQPASISCKSSQSLLDSDGKTYLNWYLQKPGQSPQLLIYLVSKLDSGVPDRFSGSGSGTDFTLKISRVEAEDVGVYYCWQGTHFPQTFGQGTKVEIK

SEQ ID NO: 1602 - DNA, 1476 bp, Artificial Sequence
  mu25E6CAR T841BB3z
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1603 - protein, 490 aa, Artificial Sequence
  mu25E6CAR T841BB3z
MALPVTALLLPLALLLHAARPEVQLVESGGDLVKPGGSLKLSCAASGFTFSSYGMSWVRQTPDKRLEWVATISNGGRHTFYPDSVKGRFTISRDNAKNTLYLQMSSLKSEDTAMYLCVRQTGTEGWFAYWGQGTLVTVSAGGGGSGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1604 - DNA, 1476 bp, Artificial Sequence
  hu25E6CAR T841BB3z
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1605 - protein, 490 aa, Artificial Sequence
  hu25E6CAR T841BB3z
MALPVTALLLPLALLLHAARPEVQLVESGGGLVKPGGSLRLSCAASGFTFSSYGMSWVRQAPGKGLEWVSTISNGGRHTFYPDSVKGRFTISRDNAKNSLYLQMNSLRAEDTAVYYCARQTGTEGWFAYWGQGTLVTVSSGGGGSGGGGSGGGGSDIVMTQTPLSLSVTPGQPASISCKSSQSLLDSDGKTYLNWYLQKPGQSPQLLIYLVSKLDSGVPDRFSGSGSGTDFTLKISRVEAEDVGVYYCWQGTHFPQTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1606 - DNA, 1473 bp, Artificial Sequence
  mu25E6CAR T8283z
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1607 - protein, 489 aa, Artificial Sequence
  mu25E6CAR T8283z
MALPVTALLLPLALLLHAARPEVQLVESGGDLVKPGGSLKLSCAASGFTFSSYGMSWVRQTPDKRLEWVATISNGGRHTFYPDSVKGRFTISRDNAKNTLYLQMSSLKSEDTAMYLCVRQTGTEGWFAYWGQGTLVTVSAGGGGSGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1608 - DNA, 1473 bp, Artificial Sequence
  hu25E6CAR T8283z
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1609 - protein, 489 aa, Artificial Sequence
  hu25E6CAR T8283z
MALPVTALLLPLALLLHAARPEVQLVESGGGLVKPGGSLRLSCAASGFTFSSYGMSWVRQAPGKGLEWVSTISNGGRHTFYPDSVKGRFTISRDNAKNSLYLQMNSLRAEDTAVYYCARQTGTEGWFAYWGQGTLVTVSSGGGGSGGGGSGGGGSDIVMTQTPLSLSVTPGQPASISCKSSQSLLDSDGKTYLNWYLQKPGQSPQLLIYLVSKLDSGVPDRFSGSGSGTDFTLKISRVEAEDVGVYYCWQGTHFPQTFGQGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1610 - DNA, 1476 bp, Artificial Sequence
  mu25E6CAR T841BB3z1XX
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1611 - protein, 490 aa, Artificial Sequence
  mu25E6CAR T841BB3z1XX
MALPVTALLLPLALLLHAARPEVQLVESGGDLVKPGGSLKLSCAASGFTFSSYGMSWVRQTPDKRLEWVATISNGGRHTFYPDSVKGRFTISRDNAKNTLYLQMSSLKSEDTAMYLCVRQTGTEGWFAYWGQGTLVTVSAGGGGSGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1612 - DNA, 1476 bp, Artificial Sequence
  hu25E6CAR T841BB3z1XX
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1613 - protein, 490 aa, Artificial Sequence
  hu25E6CAR T841BB3z1XX
MALPVTALLLPLALLLHAARPEVQLVESGGGLVKPGGSLRLSCAASGFTFSSYGMSWVRQAPGKGLEWVSTISNGGRHTFYPDSVKGRFTISRDNAKNSLYLQMNSLRAEDTAVYYCARQTGTEGWFAYWGQGTLVTVSSGGGGSGGGGSGGGGSDIVMTQTPLSLSVTPGQPASISCKSSQSLLDSDGKTYLNWYLQKPGQSPQLLIYLVSKLDSGVPDRFSGSGSGTDFTLKISRVEAEDVGVYYCWQGTHFPQTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1614 - DNA, 1473 bp, Artificial Sequence
  mu25E6CAR T8283z1XX
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1615 - protein, 489 aa, Artificial Sequence
  mu25E6CAR T8283z1XX
MALPVTALLLPLALLLHAARPEVQLVESGGDLVKPGGSLKLSCAASGFTFSSYGMSWVRQTPDKRLEWVATISNGGRHTFYPDSVKGRFTISRDNAKNTLYLQMSSLKSEDTAMYLCVRQTGTEGWFAYWGQGTLVTVSAGGGGSGGGGSGGGGSDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1616 - DNA, 1473 bp, Artificial Sequence
  hu25E6CAR T8283z1XX
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1617 - protein, 489 aa, Artificial Sequence
  hu25E6CAR T8283z1XX
MALPVTALLLPLALLLHAARPEVQLVESGGGLVKPGGSLRLSCAASGFTFSSYGMSWVRQAPGKGLEWVSTISNGGRHTFYPDSVKGRFTISRDNAKNSLYLQMNSLRAEDTAVYYCARQTGTEGWFAYWGQGTLVTVSSGGGGSGGGGSGGGGSDIVMTQTPLSLSVTPGQPASISCKSSQSLLDSDGKTYLNWYLQKPGQSPQLLIYLVSKLDSGVPDRFSGSGSGTDFTLKISRVEAEDVGVYYCWQGTHFPQTFGQGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1618 - DNA, 1533 bp, Artificial Sequence
  MNC21XX - muMNC2CAR T841BB3z1XX
atggccttaccagtgaccgccttgctcctgccgctggccttgctgctccacgccgccaggccggaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctatggcggtggcggatccggcggtggcggatccggcggtggcggatccgacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatccacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1619 - protein, 509 aa, Artificial Sequence
  MNC21XX - muMNC2CAR T841BB3z1XX
MALPVTALLLPLALLLHAARPEVQLEESGGGLVKPGGSLKLSCAASGFTFSGYAMSWVRQTPEKRLEWVATISSGGTYIYYPDSVKGRFTISRDNAKNTLYLQMSSLRSEDTAMYYCARLGGDNYYEYFDVWGAGTTVTVSSAKTTPPSVYGGGGSGGGGSGGGGSDIVITQSTASLGVSLGQRATISCRASKSVSTSGYSYMHWYQQRPGQPPKLLIYLASNLESGVPARFSGSGSGTDFTLNIHPVEEEDAATYYCQHSRELPFTFGGGTKLEIKRADAAPTVSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1620 - DNA, 1485 bp, Artificial Sequence
  huMNC2CAR T841BB3z1XX
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1621 - protein, 493 aa, Artificial Sequence
  huMNC2CAR T841BB3z1XX
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1622 - DNA, 1530 bp, Artificial Sequence
  muMNC2CAR T8283z1XX
atggccttaccagtgaccgccttgctcctgccgctggccttgctgctccacgccgccaggccggaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctatggcggtggcggatccggcggtggcggatccggcggtggcggatccgacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatccacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1623 - protein, 508 aa, Artificial Sequence
  muMNC2CAR T8283z1XX
MALPVTALLLPLALLLHAARPEVQLEESGGGLVKPGGSLKLSCAASGFTFSGYAMSWVRQTPEKRLEWVATISSGGTYIYYPDSVKGRFTISRDNAKNTLYLQMSSLRSEDTAMYYCARLGGDNYYEYFDVWGAGTTVTVSSAKTTPPSVYGGGGSGGGGSGGGGSDIVITQSTASLGVSLGQRATISCRASKSVSTSGYSYMHWYQQRPGQPPKLLIYLASNLESGVPARFSGSGSGTDFTLNIHPVEEEDAATYYCQHSRELPFTFGGGTKLEIKRADAAPTVSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1624 - DNA, 1482 bp, Artificial Sequence
  huMNC2CAR T8283z1XX
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1625 - protein, 492 aa, Artificial Sequence
  huMNC2CAR T8283z1XX
MALPVTALLLPLALLLHAARPEVQLVESGGGLVKPGGSLRLSCAASGFTFSGYAMSWVRQAPGKGLEWVSTISSGGTYIYYPDSVKGRFTISRDNAKNSLYLQMNSLRAEDTAVYYCARLGGDNYYEYFDVWGKGTTVTVSSGGGGSGGGGSGGGGSDIVLTQSPASLAVSPGQRATITCRASKSVSTSGYSYMHWYQQKPGQPPKLLIYLASNLESGVPARFSGSGSGTDFTLTINPVEANDTANYYCQHSRELPFTFGGGTKVEIKRTTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1626 - DNA, 1467 bp, Artificial Sequence
  MNE61XX - muMNE6CAR T841BB3z1XX
atggccttaccagtgaccgccttgctcctgccgctggccttgctgctccacgccgccaggccggaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctcaggcggtggcggatccggcggtggcggatccggcggtggcggatcccaaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1627 - protein, 487 aa, Artificial Sequence
  MNE61XX - muMNE6CAR T841BB3z1XX
MALPVTALLLPLALLLHAARPEVKVVESGGDLVKPGGSLKLSCVVSGFTFSRYGMSWVRQTPGKRLEWVATISGGGTYIYYPDSVKGRFTISRDNAKNTLYLQMSSLKSEDTAMYHCTRDNYGRNYDYGMDYWGQGTSVTVSSGGGGSGGGGSGGGGSQIVLTQSPAIMSASPGEEVTLTCSATSSVSYIHWFQQRPGTSPKLWIYSTSNLASGVPVRFSGSGYGTSYSLTISRMEAEDAATYYCQQRSSSPFTFGSGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1628 - DNA, 1467 bp, Artificial Sequence
  huMNE6CAR T841BB3z1XX
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1629 - protein, 487 aa, Artificial Sequence
  huMNE6CAR T841BB3z1XX
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1630 - DNA, 1464 bp, Artificial Sequence
  muMNE6CAR T84283z1XX
atggccttaccagtgaccgccttgctcctgccgctggccttgctgctccacgccgccaggccggaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctcaggcggtggcggatccggcggtggcggatccggcggtggcggatcccaaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1631 - protein, 486 aa, Artificial Sequence
  muMNE6CAR T84283z1XX
MALPVTALLLPLALLLHAARPEVKVVESGGDLVKPGGSLKLSCVVSGFTFSRYGMSWVRQTPGKRLEWVATISGGGTYIYYPDSVKGRFTISRDNAKNTLYLQMSSLKSEDTAMYHCTRDNYGRNYDYGMDYWGQGTSVTVSSGGGGSGGGGSGGGGSQIVLTQSPAIMSASPGEEVTLTCSATSSVSYIHWFQQRPGTSPKLWIYSTSNLASGVPVRFSGSGYGTSYSLTISRMEAEDAATYYCQQRSSSPFTFGSGTKLEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1632 - DNA, 1464 bp, Artificial Sequence
  huMNE6CAR T84283z1XX
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1633 - protein, 486 aa, Artificial Sequence
  huMNE6CAR T84283z1XX
MALPVTALLLPLALLLHAARPEVQLVESGGGLVKPGGSLRLSCAASGFTFSRYGMSWVRQAPGKRLEWVSTISGGGTYIYYPDSVKGRFTISRDNAKNTLYLQMNSLRAEDTAVYYCTRDNYGRNYDYGMDYWGQGTLVTVSSGGGGSGGGGSGGGGSEIVLTQSPATLSLSPGERATLTCSATSSVSYIHWYQQRPGQSPRLLIYSTSNLASGIPARFSGSGSGSDYTLTISSLEPEDFAVYYCQQRSSSPFTFGSGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLFNELQKDKMAEAFSEIGMKGERRRGKGHDGLFQGLSTATKDTFDALHMQALPPR

SEQ ID NO: 1634 - DNA, 117 bp, Artificial Sequence
  Minimal CMV promoter (mCMV)
taggcgtgtacggtgggaggcctatataagcagagctcgtttagtgaaccgtcagatcgcctggagacgccatccacgctgttttgacctccatagaagacaccgggaccgatccag

SEQ ID NO: 1635 - DNA, 114 bp, Artificial Sequence
  Minimal IL2 promoter (mIL2P)
cattttgacacccccataatatttttccagaattaacagtataaattgcatctcttgttcaagagttccctatcactctctttaatcactactcacagtaacctcaactcctgc

SEQ ID NO: 1636 - DNA, 31 bp, Artificial Sequence
  Minimal promoter, miniP
agagggtatataatggaagctcgacttccag

SEQ ID NO: 1637 - DNA, 540 bp, Artificial Sequence
  IL18 activated
atggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1638 - protein, 178 aa, Artificial Sequence
  IL18 activated
MALPVTALLLPLALLLHAARPYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 1639 - DNA, 770 bp, Artificial Sequence
  Foxp3NFATc1X3IL18
ggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1640 - DNA, 850 bp, Artificial Sequence
  Foxp3NFATc1X6IL18
gcttcattttttccatttactgcagaggcttcattttttccatttactgcagaggcttcattttttccatttactgcagaggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1641 - DNA, 779 bp, Artificial Sequence
  IL2NFATc1X3IL18
ggaggaaaaactgtttcatacagaaggcgtggaggaaaaactgtttcatacagaaggcgtggaggaaaaactgtttcatacagaaggcgtactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1642 - DNA, 868 bp, Artificial Sequence
  IL2NFATc1X6IL18
ggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtactagttaggcgtgtacggtgggaggcctatataagcagagctcgtttagtgaaccgtcagatcgcctggagacgccatccacgctgttttgacctccatagaagacaccgggaccgatccagctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1643 - DNA, 2347 bp, Artificial Sequence
  Best antibodies with inducible IL18 +/ 1XX mutations in ITAMs of CD3zeta - MNC2 - muMNC2841BB3zFoxp3NFATIL18
atggccttaccagtgaccgccttgctcctgccgctggccttgctgctccacgccgccaggccggaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctatggcggtggcggatccggcggtggcggatccggcggtggcggatccgacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatccacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1644 - DNA, 2299 bp, Artificial Sequence
  huMNC2841BB3zFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1645 - DNA, 2344 bp, Artificial Sequence
  muMNC28283zFoxp3NFATIL18
atggccttaccagtgaccgccttgctcctgccgctggccttgctgctccacgccgccaggccggaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctatggcggtggcggatccggcggtggcggatccggcggtggcggatccgacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatccacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1646 - DNA, 2296 bp, Artificial Sequence
  huMNC28283zFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1647 - DNA, 2347 bp, Artificial Sequence
  muMNC2841BB3z1XXFoxp3NFATIL18
atggccttaccagtgaccgccttgctcctgccgctggccttgctgctccacgccgccaggccggaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctatggcggtggcggatccggcggtggcggatccggcggtggcggatccgacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatccacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1648 - DNA, 2299 bp, Artificial Sequence
  huMNC2841BB3z1XXFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1649 - DNA, 2344 bp, Artificial Sequence
  muMNC28283z1XXFoxp3NFATIL18
atggccttaccagtgaccgccttgctcctgccgctggccttgctgctccacgccgccaggccggaggtccagctggaggagtcagggggaggcttagtgaagcctggagggtccctgaaactctcctgtgcagcctctggattcactttcagtggctatgccatgtcttgggttcgccagactccggagaagaggctggagtgggtcgcaaccattagtagtggtggtacttatatctactatccagacagtgtgaaggggcgattcaccatctccagagacaatgccaagaacaccctgtacctgcaaatgagcagtctgaggtctgaggacacggccatgtattactgtgcaagacttgggggggataattactacgaatacttcgatgtctggggcgcagggaccacggtcaccgtctcctccgccaaaacgacacccccatctgtctatggcggtggcggatccggcggtggcggatccggcggtggcggatccgacattgtgatcacacagtctacagcttccttaggtgtatctctggggcagagggccaccatctcatgcagggccagcaaaagtgtcagtacatctggctatagttatatgcactggtaccaacagagaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttccgttcacgttcggaggggggaccaagctggagataaaacgggctgatgctgcaccaactgtatccacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1650 - DNA, 2296 bp, Artificial Sequence
  huMNC28283z1XXFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1651 - DNA, 2281 bp, Artificial Sequence
  muMNE6841BB3zFoxp3NFATIL18
atggccttaccagtgaccgccttgctcctgccgctggccttgctgctccacgccgccaggccggaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctcaggcggtggcggatccggcggtggcggatccggcggtggcggatcccaaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1652 - DNA, 2281 bp, Artificial Sequence
  huMNE6841BB3zFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1653 - DNA, 2278 bp, Artificial Sequence
  muMNE684283zFoxp3NFATIL18
atggccttaccagtgaccgccttgctcctgccgctggccttgctgctccacgccgccaggccggaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctcaggcggtggcggatccggcggtggcggatccggcggtggcggatcccaaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1654 - DNA, 2278 bp, Artificial Sequence
  huMNE68283zFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1655 - DNA, 2281 bp, Artificial Sequence
  muMNE6841BB3z1XXFoxp3NFATIL18
atggccttaccagtgaccgccttgctcctgccgctggccttgctgctccacgccgccaggccggaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctcaggcggtggcggatccggcggtggcggatccggcggtggcggatcccaaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1656 - DNA, 2281 bp, Artificial Sequence
  huMNE6841BB3z1XXFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1657 - DNA, 2278 bp, Artificial Sequence
  muMNE68283z1XXFoxp3NFATIL18
atggccttaccagtgaccgccttgctcctgccgctggccttgctgctccacgccgccaggccggaggtgaaggtggtggagtctgggggagacttagtgaagcctggagggtccctgaaactctcctgtgtagtctctggattcactttcagtagatatggcatgtcttgggttcgccagactccaggcaagaggctggagtgggtcgcaaccattagtggtggcggtacttacatctactatccagacagtgtgaaggggcgattcaccatctccagagacaatgccaagaacaccctgtacctgcaaatgagcagtctgaagtctgaggacacagccatgtatcactgtacaagggataactacggtaggaactacgactacggtatggactactggggtcaaggaacctcagtcaccgtctcctcaggcggtggcggatccggcggtggcggatccggcggtggcggatcccaaattgttctcacccagtctccagcaatcatgtctgcatctccaggggaggaggtcaccctaacctgcagtgccacctcaagtgtaagttacatacactggttccagcagaggccaggcacttctcccaaactctggatttatagcacatccaacctggcttctggagtccctgttcgcttcagtggcagtggatatgggacctcttactctctcacaatcagccgaatggaggctgaagatgctgccacttattactgccagcaaaggagtagttccccattcacgttcggctcggggacaaagttggaaataaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1658 - DNA, 2278 bp, Artificial Sequence
  huMNE68283z1XXFoxp3NFATIL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtaggtatggcatgagctgggtccgccaggctccagggaagaggctggagtgggtctcaaccattagtggcggaggcacctacatatactacccagactcagtgaagggccgattcaccatctccagagacaacgccaagaacaccctgtatctgcaaatgaacagcctgagagccgaggacacggctgtgtattactgtaccagagataactatggccgcaactatgattatggcatggattattggggccagggcaccctggtgaccgtgagcagcggcggtggcggatccggcggtggcggatccggcggtggcggatccgaaattgtgttgacacagtctccagccaccctgtctttgtctccaggggaaagagccaccctcacctgcagcgccaccagcagtgttagctacatccactggtaccaacagaggcctggccagagccccaggctcctcatctatagcacctccaacctggccagcggcatcccagccaggttcagtggcagtgggtctgggagcgactacactctcaccatcagcagcctagagcctgaagattttgcagtttattactgtcagcagcgtagcagctcccctttcacctttggcagcggcaccaaagtggaaattaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1659 - DNA, 2293 bp, Artificial Sequence
  mu20A10841BB3zFoxp3NFATIL18
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1660 - DNA, 2296 bp, Artificial Sequence
  hu20A10841BB3zFoxp3NFATIL18
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1661 - DNA, 2290 bp, Artificial Sequence
  mu20A108283zFoxp3NFATIL18
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1662 - DNA, 2293 bp, Artificial Sequence
  hu20A108283zFoxp3NFATIL18
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1663 - DNA, 2293 bp, Artificial Sequence
  mu20A10841BB3z1XXFoxp3NFATIL18
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1664 - DNA, 2296 bp, Artificial Sequence
  hu20A10841BB3z1XXFoxp3NFATIL18
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1665 - DNA, 2290 bp, Artificial Sequence
  mu20A108283z1XXFoxp3NFATIL18
atggccttaccagtgaccgccttgctcctgccgctggccttgctgctccacgccgccaggccggaagtgatgctggtggaatctggcggcggactggttaagcctggcggatctctgaagctgagctgtgccgccagcggcttcacctttagcacatacgccatgagctggatccggcagacccctgagaagagactggaatgggttgccagcatcggcagagccggcagcacctactacagcgattctgtgaagggcagattcaccatcagccgggacaacgtgcggaacatcctgtacctgcagatgagcagcctgcggagcgaggataccgccatgtactactgtgccagaggacccatctacaacgactacgacgagttcgcctattggggccagggcacactggttacagtttctgctggtggcggaggatctggcggaggtggaagcggcggaggcggatccaatatcatgatgacacagagcccgagcagcctggctgtgtctgctggcgagaaagtgaccatgtcctgcaagagcagccagagcgtgctgtactccagcaaccagaagaactacctggcctggtatcagcagaagcccggccagtctcctaagctgctgatctactgggccagcaccagagaaagcggcgtgcccgatagattcacaggcagcggcagcggaaccgacttcaccctgacaatcagctctgtgcaggccgaagatctggccgtgtactattgccaccagtacctgtccagcctgacctttggcgccggaacaaagctggaactgaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1666 - DNA, 2293 bp, Artificial Sequence
  hu20A108283z1XXFoxp3NFATIL18
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacattgtgctgacccagtctccagcctccttggccgtgtctccaggacagagggccaccatcacctgcaagagcagccagagcgtgctgtactccagcaaccagaagaactacctggcctggtatcagcagaaaccaggacaacctcctaaactcctgatttactgggccagcaccagagaaagcggggtcccagccaggttcagcggcagtgggtctgggaccgatttcaccctcacaattaatcctgtggaagctaatgatactgcaaattattactgtcaccagtacctgagcagcctgaccttcggcggagggaccaaggtggagatcaaacgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1667 - DNA, 2290 bp, Artificial Sequence
  mu25E6841BB3zFoxp3NFATIL18
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1668 - DNA, 2290 bp, Artificial Sequence
  hu25E6841BB3zFoxp3NFATIL18
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1669 - DNA, 2287 bp, Artificial Sequence
  mu25E68283zFoxp3NFATIL18
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1670 - DNA, 2287 bp, Artificial Sequence
  hu25E68283zFoxp3NFATIL18
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1671 - DNA, 2290 bp, Artificial Sequence
  mu25E6841BB3z1XXFoxp3NFATIL18
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1672 - DNA, 2290 bp, Artificial Sequence
  hu25E6841BB3z1XXFoxp3NFATIL18
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1673 - DNA, 2287 bp, Artificial Sequence
  mu25E68283z1XXFoxp3NFATIL18
atggccttaccagtgaccgccttgctcctgccgctggccttgctgctccacgccgccaggccggaggtgcagctggtggagtctgggggagacttagtgaagcctggagggtccctgaaactctcctgtgcagcctctggtttcactttcagtagttatggaatgtcttgggttcgccagactccagacaagaggctggagtgggtcgcaaccattagtaatggtggtagacacaccttctatccagacagtgtgaaggggcgattcaccatctccagagacaatgccaagaacaccctgtatctgcaaatgagcagtctgaagtctgaggacacagccatgtatttatgtgtaagacagactgggacggagggctggtttgcttactggggccaagggactctggtcactgtctctgcaggtggcggaggatctggcggaggtggaagcggcggaggcggatccgatgttgtgatgacccagactccactcactttgtcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctggaaatcaaaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1674 - DNA, 2287 bp, Artificial Sequence
  hu25E68283z1XXFoxp3NFATIL18
atggccttaccagtgaccgccttgctcctgccgctggccttgctgctccacgccgccaggccggaggtgcagctggtggaatctggcggaggactggtcaagcctggaggcagcctgagactgagctgcgccgccagcggcttcacattcagcagctacggcatgagctgggtgcggcaggcccctggcaagggcctggaatgggtcagcaccatcagcaacggcggaagacacaccttctaccccgacagcgtgaagggcagattcaccatctcaagagataacgccaagaacagcctgtacctgcagatgaacagcctgcgggccgaggacaccgccgtgtactactgcgccagacagaccggcacagagggctggttcgcctactggggccagggcaccctggtgaccgtgtccagcggcggtggcggaagcggaggcggtggctccggtggcggaggcagcgacatcgtgatgacccagacccctctgtctctgagcgtgacccctggccagcctgccagcatctcttgtaaaagcagccagagcctgctggacagcgacggcaagacctacctgaactggtacctgcagaagcccggccaaagccctcagctgctgatctacctggtgtccaagctggatagcggtgttcctgatagattcagcggatctggcagcggcaccgacttcaccctgaagatcagcagagtggaagccgaggacgtgggcgtgtactactgctggcagggcacacacttcccccagacattcggccagggcaccaaggtggaaatcaagacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1675 - DNA, 1482 bp, Artificial Sequence
  pCDH MSCV h20A10-O CAR 41BB
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacatcgtgatgacacagagccctgatagcctggccgtgtctctgggagagagagccaccatcaactgcaagagcagccagagcgtgctgtactccagcaaccagaagaactacctggcctggtatcagcagaagcccggccagcctcctaagctgctgatctactgggccagcaccagagaaagcggcgtgcccgatagattttctggcagcggctctggcaccgacttcaccctgacaattagctccctgcaggccgaggatgtggccgtgtactactgtcaccagtacctgagcagcctgacctttggcggcggaacaaaggtggaaatcaagcgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1676 - DNA, 63 bp, Artificial Sequence
  CD8 leader sequence
atggccttaccagtgaccgccttgctcctgccgctggccttgctgctccacgccgccaggccg

SEQ ID NO: 1677 - DNA, 744 bp, Artificial Sequence
  h20A10O scFV
gaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacatcgtgatgacacagagccctgatagcctggccgtgtctctgggagagagagccaccatcaactgcaagagcagccagagcgtgctgtactccagcaaccagaagaactacctggcctggtatcagcagaagcccggccagcctcctaagctgctgatctactgggccagcaccagagaaagcggcgtgcccgatagattttctggcagcggctctggcaccgacttcaccctgacaattagctccctgcaggccgaggatgtggccgtgtactactgtcaccagtacctgagcagcctgacctttggcggcggaacaaaggtggaaatcaagcga

SEQ ID NO: 1678 - DNA, 135 bp, Artificial Sequence
  CD8 hinge region
acaacaacccctgcccccagacctcctaccccagcccctacaattgccagccagcctctgagcctgaggcccgaggcttgtagacctgctgctggcggagccgtgcacaccagaggactggatttcgcctgcgac

SEQ ID NO: 1679 - DNA, 63 bp, Artificial Sequence; identical to SEQ ID NO: 1676
  CD8 leader sequence

SEQ ID NO: 1680 - DNA, 744 bp, Artificial Sequence; identical to SEQ ID NO: 1580
  h20A10N scFV

SEQ ID NO: 1681 - DNA, 135 bp, Artificial Sequence; identical to SEQ ID NO: 1678
  CD8 hinge region

SEQ ID NO: 1682 - DNA, 72 bp, Artificial Sequence; identical to SEQ ID NO: 656
  CD8 transmembrane domain

SEQ ID NO: 1683 - DNA, 126 bp, Artificial Sequence; identical to SEQ ID NO: 658
  41BB

SEQ ID NO: 1684 - DNA, 342 bp, Artificial Sequence
  CD3
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1685 - DNA, 1482 bp, Artificial Sequence; identical to SEQ ID NO: 1584
  pCDH MSCV h20A10-C2 CAR 41BB

SEQ ID NO: 1686 - DNA, 63 bp, Artificial Sequence; identical to SEQ ID NO: 1676
  CD8 leader sequence

SEQ ID NO: 1687 - DNA, 744 bp, Artificial Sequence; identical to SEQ ID NO: 1578
  h20A10C2 scFV

SEQ ID NO: 1688 - DNA, 135 bp, Artificial Sequence; identical to SEQ ID NO: 1678
  CD8 hinge region

SEQ ID NO: 1689 - DNA, 72 bp, Artificial Sequence; identical to SEQ ID NO: 656
  CD8 transmembrane region

SEQ ID NO: 1690 - DNA, 126 bp, Artificial Sequence; identical to SEQ ID NO: 658
  41BB

SEQ ID NO: 1691 - DNA, 342 bp, Artificial Sequence; identical to SEQ ID NO: 1684
  CD3

SEQ ID NO: 1692 - DNA, 1479 bp, Artificial Sequence
  pCDH MSCV h20A10-O CAR CD28 1XX
atggccttaccagtgaccgccttgctcctgccgctggccttgctgctccacgccgccaggccggaggtgcagctggttgaatctggcggcggacttgtgaagcctggcggatctctgagactgagctgtgccgccagcggcttcacctttagcacatacgccatgagctgggtccgacaggcccctggaaaaggccttgaatgggttgcctctatcggcagagccggcagcacctactacagcgattctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtcagctctggcggtggcggaagcggaggcggtggctccggtggcggaggcagcgacatcgtgatgacacagagccctgatagcctggccgtgtctctgggagagagagccaccatcaactgcaagagcagccagagcgtgctgtactccagcaaccagaagaactacctggcctggtatcagcagaagcccggccagcctcctaagctgctgatctactgggccagcaccagagaaagcggcgtgcccgatagattttctggcagcggctctggcaccgacttcaccctgacaattagctccctgcaggccgaggatgtggccgtgtactactgtcaccagtacctgagcagcctgacctttggcggcggaacaaaggtggaaatcaagcgaacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1693 - DNA, 63 bp, Artificial Sequence; identical to SEQ ID NO: 1676
  CD8 leader sequence

SEQ ID NO: 1694 - DNA, 744 bp, Artificial Sequence; identical to SEQ ID NO: 1677
  h20A10O scFV

SEQ ID NO: 1695 - DNA, 135 bp, Artificial Sequence; identical to SEQ ID NO: 1678
  CD8 hinge region

SEQ ID NO: 1696 - DNA, 72 bp, Artificial Sequence; identical to SEQ ID NO: 656
  CD8 transmembrane region

SEQ ID NO: 1697 - DNA, 123 bp, Artificial Sequence
  CD28
aggagtaagaggagcaggctcctgcacagtgactacatgaacatgactcctagaagacctgggcctaccagaaagcattaccagccctatgccccaccacgcgacttcgcagcctatcgctcc

SEQ ID NO: 1698 - DNA, 342 bp, Artificial Sequence
  CD3 1XX
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1699 - DNA, 1479 bp, Artificial Sequence
  pCDH MSCV h20A10-N CAR CD28 1XX
atggccttaccagtgaccgccttgctcctgccgctggccttgctgctccacgccgccaggccgcaggtgcagctggttgaatctggcggcggacttgtgaagcctggcggatctctgagactgagctgtgccgccagcggcttcacctttagcacatacgccatgagctggatcagacaggcccctggcaaaggcctggaatgggtggcgtctattggcagagccggcagcacctactacagcgactctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtttctagcggcggtggcggaagcggaggcggtggctccggtggcggaggcagcgaaattgtgctgacacagagccccgccacactgtcactttctccaggcgaaagagccacactgagctgcaagagcagccagagcgtgctgtactccagcaaccagaagaactacctggcctggtatcagcagaagcccggccaagctcctcggctgctgatctattgggccagcacaagagagagcggcatccctgccagattttctggcagcggctctggcaccgatttcaccctgaccataagcagcctggaacctgaggacttcgccgtgtattactgccaccagtacctgagcagcctgacctttggcggaggcaccaaggtggaaatcaagcggacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaggagtaagaggagcaggctcctgcacagtgactacatgaacatgactcctagaagacctgggcctaccagaaagcattaccagccctatgccccaccacgcgacttcgcagcctatcgctccagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgttcaatgaactgcagaaagataagatggcggaggccttcagtgagattgggatgaaaggcgagcgccggaggggcaaggggcacgatggccttttccagggtctcagtacagccaccaaggacaccttcgacgcccttcacatgcaggccctgccccctcgctgataa

SEQ ID NO: 1700 - DNA, 63 bp, Artificial Sequence; identical to SEQ ID NO: 1676
  CD8 leader sequence

SEQ ID NO: 1701 - DNA, 744 bp, Artificial Sequence; identical to SEQ ID NO: 1580
  h20A10N scFV

SEQ ID NO: 1702 - DNA, 135 bp, Artificial Sequence; identical to SEQ ID NO: 1678
  CD8 hinge region

SEQ ID NO: 1703 - DNA, 72 bp, Artificial Sequence; identical to SEQ ID NO: 656
  CD8 transmembrane domain

SEQ ID NO: 1704 - DNA, 123 bp, Artificial Sequence; identical to SEQ ID NO: 1697
  CD28

SEQ ID NO: 1705 - DNA, 342 bp, Artificial Sequence; identical to SEQ ID NO: 1698
  CD3 1XX

SEQ ID NO: 1706 - DNA, 1479 bp, Artificial Sequence; identical to SEQ ID NO: 1596
  pCDH MSCV h20A10-C2 CAR CD28 1XX

SEQ ID NO: 1707 - DNA, 63 bp, Artificial Sequence; identical to SEQ ID NO: 1676
  CD8 leader sequence

SEQ ID NO: 1708 - DNA, 744 bp, Artificial Sequence; identical to SEQ ID NO: 1578
  h20A10C2 scFV

SEQ ID NO: 1709 - DNA, 135 bp, Artificial Sequence; identical to SEQ ID NO: 1678
  CD8 hinge region

SEQ ID NO: 1710 - DNA, 72 bp, Artificial Sequence; identical to SEQ ID NO: 656
  CD8 transmembrane region

SEQ ID NO: 1711 - DNA, 123 bp, Artificial Sequence; identical to SEQ ID NO: 1697
  CD28

SEQ ID NO: 1712 - DNA, 342 bp, Artificial Sequence; identical to SEQ ID NO: 1698
  CD3 1XX

SEQ ID NO: 1713 - DNA, 2380 bp, Artificial Sequence
  pCDH MSCV hC2 CAR 41BB 6xNFATFoxP3 IL18
atggccttaccagtgaccgccttgctcctgccgctggccttgctgctccacgccgccaggccggaggtgcagctggtggagtctgggggaggcctggtcaagcctggggggtccctgagactctcctgtgcagcctctggattcaccttcagtggctatgccatgagctgggtccgccaggctccagggaaggggctggagtgggtctcaaccattagtagtggcggaacctacatatactaccccgactcagtgaagggccgattcaccatctccagagacaacgccaagaactcactgtatctgcaaatgaacagcctgagagccgaggacacggccgtgtattactgtgcgagacttgggggggataattactacgaatacttcgatgtctggggcaaagggaccacggtcaccgtctcctccggcggtggcggatccggcggtggcggatccggcggtggcggatccgacattgtgctgacccagtctccagcctccttggccgtgtctccaggacagagggccaccatcacctgcagagccagtaagagtgtcagtaccagcggatactcctacatgcactggtatcagcagaaaccaggacaacctcctaaactcctgatttacctggcatccaatctggagagcggggtcccagccaggttcagcggcagtgggtctgggaccgatttcaccctcacaattaatcctgtggaagctaatgatactgcaaattattactgtcagcacagtagggagctgcctttcacattcggcggagggaccaaggtggagatcaaacgaactacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataagtttaaactgccagaacatttctctggcctaactggccggtaccggcttcattttttccatttactgcagaggcttcattttttccatttactgcagaggcttcattttttccatttactgcagaggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1714 - DNA, 63 bp, Artificial Sequence; identical to SEQ ID NO: 1676
  CD8 leader sequence

SEQ ID NO: 1715 - DNA, 747 bp, Artificial Sequence; identical to SEQ ID NO: 238
  C2 scFV

SEQ ID NO: 1716 - DNA, 135 bp, Artificial Sequence; identical to SEQ ID NO: 1678
  CD8 hinge region

SEQ ID NO: 1717 - DNA, 72 bp, Artificial Sequence; identical to SEQ ID NO: 656
  CD8 transmembrane region

SEQ ID NO: 1718 - DNA, 126 bp, Artificial Sequence; identical to SEQ ID NO: 658
  41BB

SEQ ID NO: 1719 - DNA, 336 bp, Artificial Sequence; identical to SEQ ID NO: 660
  CD3

SEQ ID NO: 1720 - DNA, 50 bp, Artificial Sequence
  plasmid
tgataagtttaaactgccagaacatttctctggcctaactggccggtacc

SEQ ID NO: 1721 - DNA, 168 bp, Artificial Sequence
  6xNFAT FoxP3
ggcttcattttttccatttactgcagaggcttcattttttccatttactgcagaggcttcattttttccatttactgcagaggcttcattttttccatttactgcagaggcttcattttttccatttactgcagaggcttcattttttccatttactgcagaactagt

SEQ ID NO: 1722 - DNA, 118 bp, Artificial Sequence; identical to SEQ ID NO: 778
  mCMV

SEQ ID NO: 1723 - DNA, 25 bp, Artificial Sequence
  plasmid
ctcgagagacccaatgctagccacc

SEQ ID NO: 1724 - DNA, 63 bp, Artificial Sequence; identical to SEQ ID NO: 1676
  CD8 leader sequence

SEQ ID NO: 1725 - DNA, 477 bp, Artificial Sequence
  IL18
tacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataa

SEQ ID NO: 1726 - DNA, 1482 bp, Artificial Sequence; identical to SEQ ID NO: 1624
  pCDH MSCV hC2 CAR CD28 1XX

SEQ ID NO: 1727 - DNA, 63 bp, Artificial Sequence; identical to SEQ ID NO: 1676
  CD8 leader sequence

SEQ ID NO: 1728 - DNA, 747 bp, Artificial Sequence; identical to SEQ ID NO: 238
  C2 scFV

SEQ ID NO: 1729 - DNA, 135 bp, Artificial Sequence; identical to SEQ ID NO: 1678
  CD8 hinge region

SEQ ID NO: 1730 - DNA, 72 bp, Artificial Sequence; identical to SEQ ID NO: 656
  CD8 transmembrane region

SEQ ID NO: 1731 - DNA, 123 bp, Artificial Sequence; identical to SEQ ID NO: 1697
  CD28

SEQ ID NO: 1732 - DNA, 342 bp, Artificial Sequence; identical to SEQ ID NO: 1698
  CD3 1XX

SEQ ID NO: 1733 - DNA, 45 bp, Artificial Sequence; identical to SEQ ID NO: 1506
  Mouse B12 light chain variable framework 2 (FR2) sequence

SEQ ID NO: 1734 - protein, 15 aa, Artificial Sequence
  Mouse B12 light chain variable framework 2 (FR2) sequence
WYQQKPGQPPKLLIY

SEQ ID NO: 1735 - DNA, 21 bp, Artificial Sequence
  Mouse B12 light chain variable complementarity determining regions 2 (CDR2) sequence
cttgcatccaccctagattct

SEQ ID NO: 1736 - protein, 7 aa, Artificial Sequence
  Mouse B12 light chain variable complementarity determining regions 2 (CDR2) sequence
LASTLDS

SEQ ID NO: 1737 - DNA, 96 bp, Artificial Sequence; identical to SEQ ID NO: 1510
  Mouse B12 light chain variable framework 3 (FR3) sequence

SEQ ID NO: 1738 - protein, 32 aa, Artificial Sequence; identical to SEQ ID NO: 1511
  Mouse B12 light chain variable framework 3 (FR3) sequence

SEQ ID NO: 1739 - DNA, 27 bp, Artificial Sequence
  Mouse B12 light chain variable complementarity determining regions 3 (CDR3) sequence
cagcaaaataatgaggatcctccgacg

SEQ ID NO: 1740 - protein, 9 aa, Artificial Sequence
  Mouse B12 light chain variable complementarity determining regions 3 (CDR3) sequence
QQNNEDPPT

SEQ ID NO: 1741 - DNA, 31 bp, Artificial Sequence
  Mouse B12 light chain variable framework 4 (FR4) sequence
ttcggtggaggcaccaagctggaaatcaagg

SEQ ID NO: 1742 - protein, 10 aa, Artificial Sequence
  Mouse B12 light chain variable framework 4 (FR4) sequence
FGGGTKLEIK

SEQ ID NO: 1743 - protein, 10 aa, Artificial Sequence
  epitope to which NME1 and NME7AB bind part of the 10 membrane proximal PRT
PFPFSAQSGA

SEQ ID NO: 1744 - protein, 11 aa, Artificial Sequence
  epitope to which NME1 and NME7AB bind part of the 10 membrane proximal PRT
SNIKFRPGSVV

SEQ ID NO: 1745 - protein, 7 aa, Artificial Sequence
  epitope to which NME1 and NME7AB bind part of the 10 membrane proximal PRT
ASRYNLT

SEQ ID NO: 1746 - protein, 10 aa, Artificial Sequence
  Fragment of PSMGFR
GTINVHDVET

SEQ ID NO: 1747 - protein, 4 aa, Artificial Sequence
  Fragment of PSMGFR
FPFS

SEQ ID NO: 1748 - protein, 20 aa, Artificial Sequence
  Fragment of PSMGFR
SNIKFRPGSVVVQLTLAFRE

SEQ ID NO: 1749 - protein, 9 aa, Artificial Sequence
  Fragment of PSMGFR
QFNQYKTEA

SEQ ID NO: 1750 - protein, 9 aa, Artificial Sequence
  Fragment of PSMGFR
VQLTLAFRE

SEQ ID NO: 1751 - protein, 5 aa, Artificial Sequence
  Fragment of PSMGFR
SVSDV

SEQ ID NO: 1752 - DNA, 627 bp, Artificial Sequence
  IL18 sequence
atagaagacaccgggaccgatccagcctcgagagacccaatgctagccaccatggccttaccagtgaccgccttgctcctgccgctggccttgctgctccacgccgccaggccgtacttcggcaagctggaaagcaagctgagcgtgatccggaacctgaacgaccaggtgctgttcatcgatcagggcaacagacccctgttcgaggacatgaccgacagcgactgcagagacaacgcccctcggaccatcttcatcatcagcatgtacaaggacagccagcctagaggcatggccgtgaccatctctgtgaagtgcgagaagatcagcaccctgagctgcgagaacaagatcatcagcttcaaagagatgaacccgccggacaacatcaaggacaccaagagcgacatcatattcttccagcggagcgtgcccggccacgacaacaagatgcagtttgagagcagcagctacgagggctacttcctggcctgcgagaaagagcgggacctgttcaagctgatcctgaagaaagaggacgaactgggcgaccgcagcatcatgttcaccgtgcagaacgaggactgataaaagcttggcaatccggtactgttggtaaagccacca

SEQ ID NO: 1753 - protein, 178 aa, Artificial Sequence; identical to SEQ ID NO: 1638
  IL18 sequence

SEQ ID NO: 1754 - DNA, 56 bp, Artificial Sequence
  Primer
agggagacccaagctggctagttaagcttggatggccttaccagtgaccgccttgc

SEQ ID NO: 1755 - DNA, 48 bp, Artificial Sequence
  Primer
taggccagagaaatgttctggcattatcagcgagggggcagggcctgc

SEQ ID NO: 1756 - DNA, 19 bp, Artificial Sequence
  Primer
tgccagaacatttctctgg

SEQ ID NO: 1757 - DNA, 52 bp, Artificial Sequence
  Primer
acagtcgaggctgatcagcgggtttaaacttatcagtcctcgttctgcacgg

SEQ ID NO: 1758 - DNA, 60 bp, Artificial Sequence
  Primer
atgcaggccctgccccctcgctgataagtttaaactgccagaacatttctctggcctaac

SEQ ID NO: 1759 - DNA, 59 bp, Artificial Sequence
  Primer
accggagcgatcgcagatccttcgcggccgcttatcagtcctcgttctgcacggtgaac

SEQ ID NO: 1760 - DNA, 31 bp, Artificial Sequence
  Primer
attgcactagttgaaagaccccacctgtagg

SEQ ID NO: 1761 - DNA, 26 bp, Artificial Sequence
  Primer
aatgctctagaatacgggtatccagg

SEQ ID NO: 1762 - DNA, 30 bp, Artificial Sequence
  Primer
atagcgaattcgtaccgagggccaccatgg

SEQ ID NO: 1763 - DNA, 44 bp, Artificial Sequence
  Primer
taggcctcccaccgtacacgcctaggtaccacgccttctgtatg

SEQ ID NO: 1764 - DNA, 44 bp, Artificial Sequence
  Primer
taggcctcccaccgtacacgcctaggtacctctgcagtaaatgg

SEQ ID NO: 1765 - DNA, 19 bp, Artificial Sequence
  Primer
taaggccatggtggctagc

SEQ ID NO: 1766 - DNA, 32 bp, Artificial Sequence
  Primer
aataagtttaaactgccagaacatttctctgg

SEQ ID NO: 1767 - DNA, 36 bp, Artificial Sequence
  Primer
atatagcggccgcttatcagtcctcgttctgcacgg

SEQ ID NO: 1768 - DNA, 347 bp, Artificial Sequence
  6x FoxP3NFAT mCMV
agaacatttctctggcctaactggccggtaccggcttcattttttccatttactgcagaggcttcattttttccatttactgcagaggcttcattttttccatttactgcagaggcttcattttttccatttactgcagaggcttcattttttccatttactgcagaggcttcattttttccatttactgcagaactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatgg

SEQ ID NO: 1769 - protein, 116 aa, Artificial Sequence
  6x FoxP3NFAT mCMV
RTFLWPNWPVPASFFPFTAEASFFPFTAEASFFPFTAEASFFPFTAEASFFPFTAEASFFPFTAELVRRVRWEAYISRARLVNRQIAWRRHPRCFDLHRRHRDRSSLERPNASHHG

SEQ ID NO: 1770 - DNA, 343 bp, Artificial Sequence
  6x FoxP3NFAT mIL2P
agaacatttctctggcctaactggccggtaccggcttcattttttccatttactgcagaggcttcattttttccatttactgcagaggcttcattttttccatttactgcagaggcttcattttttccatttactgcagaggcttcattttttccatttactgcagaggcttcattttttccatttactgcagaactagtcattttgacacccccataatatttttccagaattaacagtataaattgcatctcttgttcaagagttccctatcactctctttaatcactactcacagtaacctcaactcctgcctcgagagacccaatgctagccaccatgg

SEQ ID NO: 1771 - skipped

SEQ ID NO: 1772 - DNA, 260 bp, Artificial Sequence
  6x FoxP3NFAT miniP
agaacatttctctggcctaactggccggtaccggcttcattttttccatttactgcagaggcttcattttttccatttactgcagaggcttcattttttccatttactgcagaggcttcattttttccatttactgcagaggcttcattttttccatttactgcagaggcttcattttttccatttactgcagaactagtagagggtatataatggaagctcgacttccagctcgagagacccaatgctagccaccatgg

SEQ ID NO: 1773 - skipped

SEQ ID NO: 1774 - DNA, 365 bp, Artificial Sequence
  6x IL2NFAT mCMV
agaacatttctctggcctaactggccggtaccggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtactagttaggcgtgtacggtgggaggcctatataagcagagctcgtttagtgaaccgtcagatcgcctggagacgccatccacgctgttttgacctccatagaagacaccgggaccgatccagcctcgagagacccaatgctagccaccatgg

SEQ ID NO: 1775 - protein, 122 aa, Artificial Sequence
  6x IL2NFAT mCMV
RTFLWPNWPVPEEKLFHTEGVEEKLFHTEGVEEKLFHTEGVEEKLFHTEGVEEKLFHTEGVEEKLFHTEGVLVRRVRWEAYISRARLVNRQIAWRRHPRCFDLHRRHRDRSSLERPNASHHG

SEQ ID NO: 1776 - DNA, 361 bp, Artificial Sequence
  6x IL2NFAT mIL2P
agaacatttctctggcctaactggccggtaccggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtactagtcattttgacacccccataatatttttccagaattaacagtataaattgcatctcttgttcaagagttccctatcactctctttaatcactactcacagtaacctcaactcctgcctcgagagacccaatgctagccaccatgg

SEQ ID NO: 1777 - skipped

SEQ ID NO: 1778 - DNA, 278 bp, Artificial Sequence
  6x IL2NFAT miniP
agaacatttctctggcctaactggccggtaccggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtggaggaaaaactgtttcatacagaaggcgtactagtagagggtatataatggaagctcgacttccagctcgagagacccaatgctagccaccatgg

SEQ ID NO: 1779 - skipped

SEQ ID NO: 1780 - DNA, 459 bp, Artificial Sequence
  Human NME1
atggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatga

SEQ ID NO: 1781 - protein, 152 aa, Artificial Sequence
  Human NME1
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 1782 - DNA, 1131 bp, Artificial Sequence
  Human NME7
atgaatcatagtgaaagattcgttttcattgcagagtggtatgatccaaatgcttcacttcttcgacgttatgagcttttattttacccaggggatggatctgttgaaatgcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaaaacgctagccctaattaaaccagatgcaatatcaaaggctggagaaataattgaaataataaacaaagctggatttactataaccaaactcaaaatgatgatgctttcaaggaaagaagcattggattttcatgtagatcaccagtcaagaccctttttcaatgagctgatccagtttattacaactggtcctattattgccatggagattttaagagatgatgctatatgtgaatggaaaagactgctgggacctgcaaactctggagtggcacgcacagatgcttctgaaagcattagagccctctttggaacagatggcataagaaatgcagcgcatggccctgattcttttgcttctgcggccagagaaatggagttgttttttccttcaagtggaggttgtgggccggcaaacactgctaaatttactaattgtacctgttgcattgttaaaccccatgctgtcagtgaaggactgttgggaaagatcctgatggctatccgagatgcaggttttgaaatctcagctatgcagatgttcaatatggatcgggttaatgttgaggaattctatgaagtttataaaggagtagtgaccgaatatcatgacatggtgacagaaatgtattctggcccttgtgtagcaatggagattcaacagaataatgctacaaagacatttcgagaattttgtggacctgctgatcctgaaattgcccggcatttacgccctggaactctcagagcaatctttggtaaaactaagatccagaatgctgttcactgtactgatctgccagaggatggcctattagaggttcaatacttcttcaagatcttggataattag

SEQ ID NO: 1783 - protein, 376 aa, Artificial Sequence
  Human NME7
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 1784 - DNA, 1359 bp, Artificial Sequence; identical to SEQ ID NO: 157
  Humanized C2 IgG1 heavy chain sequence

SEQ ID NO: 1785 - protein, 12 aa, Artificial Sequence
  Mouse 17H6 heavy chain variable complementarity determining regions 3 (CDR3) sequence
DYYGSNPAWFAY

SEQ ID NO: 1786 - protein, 11 aa, Artificial Sequence
  Mouse 17H6 heavy chain variable framework 4 (FW4) sequence
WGQGTLVTVSA

SEQ ID NO: 1787 - DNA, 72 bp, Artificial Sequence; identical to SEQ ID NO: 656
  CD8 transmembrane domain

SEQ ID NO: 1788 - DNA, 126 bp, Artificial Sequence; identical to SEQ ID NO: 658
  41BB

SEQ ID NO: 1789 - DNA, 342 bp, Artificial Sequence; identical to SEQ ID NO: 1684
  CD3

SEQ ID NO: 1790 - DNA, 1482 bp, Artificial Sequence
  pCDH MSCV h20A10-N CAR 41BB
atggccttaccagtgaccgccttgctcctgccgctggccttgctgctccacgccgccaggccgcaggtgcagctggttgaatctggcggcggacttgtgaagcctggcggatctctgagactgagctgtgccgccagcggcttcacctttagcacatacgccatgagctggatcagacaggcccctggcaaaggcctggaatgggtggcgtctattggcagagccggcagcacctactacagcgactctgtgaagggcagattcaccatcagccgggacaacgccaagaacagcctgtacctgcagatgaactccctgagagccgaggacaccgccgtgtactattgtgccagaggacccatctacaacgactacgacgagttcgcctattggggccagggcacactggtcacagtttctagcggcggtggcggaagcggaggcggtggctccggtggcggaggcagcgaaattgtgctgacacagagccccgccacactgtcactttctccaggcgaaagagccacactgagctgcaagagcagccagagcgtgctgtactccagcaaccagaagaactacctggcctggtatcagcagaagcccggccaagctcctcggctgctgatctattgggccagcacaagagagagcggcatccctgccagattttctggcagcggctctggcaccgatttcaccctgaccataagcagcctggaacctgaggacttcgccgtgtattactgccaccagtacctgagcagcctgacctttggcggaggcaccaaggtggaaatcaagcggacaacaacccctgcccccagacctcctaccccagcccctacaattgccagccagcctctgagcctgaggcccgaggcttgtagacctgctgctggcggagccgtgcacaccagaggactggatttcgcctgcgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctgataa

SEQ ID NO: 1791 - protein, 4 aa, Artificial Sequence
  Description of Artificial Sequence: Synthetic peptide
FPSA

SEQ ID NO: 1792 - protein, 54 aa, Artificial Sequence
  Description of Artificial Sequence: Synthetic polypeptide
VQLTLAFREGTINVHDVETQFNQYKTEAASRYNLTISDVSVSDVPFPFSAQSGA

SEQ ID NO: 1793 - protein, 5 aa, Artificial Sequence
  Description of Artificial Sequence: Synthetic peptide
DSVKG

SEQ ID NO: 1794 - protein, 9 aa, Artificial Sequence
  Description of Artificial Sequence: Synthetic peptide
FTFSGYAMS

SEQ ID NO: 1795 - protein, 9 aa, Artificial Sequence
  Description of Artificial Sequence: Synthetic peptide
FTFSRYGMS

SEQ ID NO: 1796 - protein, 9 aa, Artificial Sequence
  Description of Artificial Sequence: Synthetic peptide
FAFSTFAMS

SEQ ID NO: 1797 - protein, 9 aa, Artificial Sequence
  Description of Artificial Sequence: Synthetic peptide
FTFSTYAMS

SEQ ID NO: 1798 - protein, 9 aa, Artificial Sequence
  Description of Artificial Sequence: Synthetic peptide
ITFSTYTMS

SEQ ID NO: 1799 - protein, 9 aa, Artificial Sequence
  Description of Artificial Sequence: Synthetic peptide
FTFSSYGMS

SEQ ID NO: 1800 - protein, 6 aa, Artificial Sequence
  Description of Artificial Sequence: Synthetic peptide
HHHHHH

SEQ ID NO: 1801 - protein, 8 aa, Artificial Sequence
  Description of Artificial Sequence: Synthetic peptide
QFNQYKTE

SEQ ID NO: 1802 - protein, 18 aa, Artificial Sequence
  Description of Artificial Sequence: Synthetic peptide
SDVSVSDVPFPFSAQSGA

SEQ ID NO: 1803 - protein, 15 aa, Artificial Sequence
  Description of Artificial Sequence: Synthetic peptide
RASKSISTSDYNYIH

SEQ ID NO: 1804 - protein, 9 aa, Artificial Sequence
  Description of Artificial Sequence: Synthetic peptide
YRFTDYAMN

SEQ ID NO: 1805 - protein, 9 aa, Artificial Sequence
  Description of Artificial Sequence: Synthetic peptide
YTFTGYFLY

SEQ ID NO: 1806 - protein, 9 aa, Artificial Sequence
  Description of Artificial Sequence: Synthetic peptide
YAFSTYWMN

SEQ ID NO: 1807 - protein, 9 aa, Artificial Sequence
  Description of Artificial Sequence: Synthetic peptide
FTFNDAWMD

SEQ ID NO: 1808 - protein, 9 aa, Artificial Sequence
  Description of Artificial Sequence: Synthetic peptide
FTFSDAWMD

SEQ ID NO: 1809 - protein, 9 aa, Artificial Sequence
  Description of Artificial Sequence: Synthetic peptide
YTFTSYWMH

SEQ ID NO: 1810 - protein, 9 aa, Artificial Sequence
  Description of Artificial Sequence: Synthetic peptide
FTFSNYWMN

SEQ ID NO: 1811 - protein, 9 aa, Artificial Sequence
  Description of Artificial Sequence: Synthetic peptide
YTFTNYGMN

SEQ ID NO: 1812 - protein, 16 aa, Artificial Sequence
  Description of Artificial Sequence: Synthetic peptide
RSSQSIVHSNGNTYLE

SEQ ID NO: 1813 - protein, 15 aa, Artificial Sequence
  Description of Artificial Sequence: Synthetic peptide
RSSQSIVHRNGNTYL

What is claimed is:
1. A single chain variable fragment (scFv) antibody that binds to the extracellular domain of MUC1*, wherein:
a. the scFv comprises a sequence having at least 95% identity to SEQ ID NO: 1577, SEQ ID NO: 1579, or SEQ ID NO: 1581; and
b. the scFv comprises a heavy chain (HC) sequence and a light chain (LC) sequence, the HC sequence comprises three HC complementarity determining regions (CDRs): HC-CDR1, HC-CDR2, and HC-CDR3, the LC sequence comprises three LC CDRs: LC-CDR1, LC-CDR2, and LC-CDR3, and
HC-CDR1 comprises SEQ ID NO: 993 or SEQ ID NO: 1797,
HC-CDR2 comprises SEQ ID NO: 997,
HC-CDR3 comprises SEQ ID NO: 1001,
LC-CDR1 comprises SEQ ID NO: 1009,
LC-CDR2 comprises SEQ ID NO: 1013, and
LC-CDR3 comprises SEQ ID NO: 1017.
2. The scFv of claim 1, wherein the scFv comprises SEQ ID NO: 1577, SEQ ID NO: 1579, or SEQ ID NO: 1581.

3. A scFv-Fc comprising the scFv of claim 1 or claim 2.
4. A chimeric antigen receptor (CAR) comprising the scFv of claim 1 or claim 2.
5. The CAR of claim 4, wherein the CAR comprises a sequence selected from the group consisting of SEQ ID NO: 1583, SEQ ID NO: 1585, SEQ ID NO: 1587, and SEQ ID NO: 1589.
6. The CAR of claim 4, wherein the CAR comprises a sequence selected from the group consisting of SEQ ID NO: 1591, SEQ ID NO: 1593, SEQ ID NO: 1595, and SEQ ID NO: 1597.
7. A bi-specific T-cell engager comprising the scFv of claim 1 or claim 2.
8. A bivalent single chain variable fragment (bi-scFv) comprising a first scFv comprising the scFv of claim 1 or claim 2 and a second scFv, wherein the first scFv associates with the second scFv to form a dimer.

* * * * *